United States Patent
Hou et al.

(10) Patent No.: US 10,934,536 B2
(45) Date of Patent: Mar. 2, 2021

(54) CRISPR-CAS SYSTEMS FOR GENOME EDITING

(71) Applicant: PIONEER HI-BRED INTERNATIONAL, INC., Johnston, IA (US)

(72) Inventors: Zhenglin Hou, Ankeny, IA (US); Tautvydas Karvelis, Paberze (LT); Virginijus Siksnys, Vilnius (LT); Joshua K Young, Johnston, IA (US)

(73) Assignee: PIONEER HI-BRED INTERNATIONAL, INC.IA (US)

( * ) Notice: Subject to any disclaimer, the term of this patent is extended or adjusted under 35 U.S.C. 154(b) by 0 days.

(21) Appl. No.: 16/713,184

(22) Filed: Dec. 13, 2019

(65) Prior Publication Data

US 2020/0190494 A1 Jun. 18, 2020

Related U.S. Application Data

(60) Provisional application No. 62/913,492, filed on Oct. 10, 2019, provisional application No. 62/852,788, filed on May 24, 2019, provisional application No. 62/819,409, filed on Mar. 15, 2019, provisional application No. 62/794,427, filed on Jan. 18, 2019, provisional application No. 62/779,989, filed on Dec. 14, 2018.

(51) Int. Cl.
*C12N 15/82* (2006.01)
*C12N 9/22* (2006.01)
*C12N 15/11* (2006.01)

(52) U.S. Cl.
CPC ............... *C12N 9/22* (2013.01); *C12N 15/11* (2013.01); *C12N 15/8213* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 5,036,006 A | 7/1991 | Sanford |
| 5,959,177 A | 9/1999 | Hein et al. |
| 6,410,329 B1 | 6/2002 | Hansen |
| 7,292,055 B2 | 8/2007 | Choo et al. |
| 8,012,752 B2 | 9/2011 | Jayakumar et al. |
| 8,575,424 B2 | 11/2013 | Yau et al. |
| 8,581,036 B2 | 11/2013 | Samboju et al. |
| 8,586,361 B2 | 11/2013 | Tao et al. |
| 8,609,420 B2 | 12/2013 | Samuel et al. |
| 8,653,327 B2 | 2/2014 | Samboju et al. |
| 8,680,366 B2 | 3/2014 | Eudes et al. |
| 8,697,359 B1 | 4/2014 | Zhang |
| 8,722,410 B2 | 5/2014 | Samuel et al. |
| 8,771,945 B1 | 7/2014 | Zhang |
| 8,795,965 B2 | 8/2014 | Zhang |
| 8,865,406 B2 | 10/2014 | Zhang |
| 8,871,445 B2 | 10/2014 | Cong |
| 8,889,356 B2 | 11/2014 | Zhang |
| 8,889,418 B2 | 11/2014 | Zhang et al. |
| 8,895,308 B1 | 11/2014 | Zhang |
| 8,906,616 B2 | 12/2014 | Zhang |
| 8,932,814 B2 | 1/2015 | Cong |
| 8,945,839 B2 | 2/2015 | Zhang |
| 8,993,233 B2 | 3/2015 | Zhang et al. |
| 8,999,641 B2 | 4/2015 | Zhang et al. |
| 9,163,284 B2 | 10/2015 | Liu et al. |
| 9,187,755 B2 | 11/2015 | Samuel et al. |
| 9,382,548 B2 | 7/2016 | Eudes et al. |
| 9,476,057 B2 | 10/2016 | Samuel et al. |
| 9,493,782 B2 | 11/2016 | Cigan |
| 9,719,108 B2 | 8/2017 | Samuel et al. |
| 9,840,713 B2 | 12/2017 | Zhang |
| 9,885,033 B2 | 11/2018 | Joung |
| 10,208,298 B2 | 2/2019 | Frisch et al. |
| 10,227,576 B1 | 3/2019 | Cameron et al. |

(Continued)

FOREIGN PATENT DOCUMENTS

| | | |
|---|---|---|
| DE | 102015006335 | 11/2016 |
| WO | 2005049842 | 6/2005 |

(Continued)

OTHER PUBLICATIONS

Abler et al: "Control of mRNA stability in higher plants", Plant Mol Biol, 1996, vol. 32, pp. 63-78.

(Continued)

*Primary Examiner* — Matthew R Keogh

(57) ABSTRACT

Compositions and methods are provided for genome modification of a target sequence in the genome of a cell, using a novel Cas endonuclease. The methods and compositions employ a guide polynucleotide/endonuclease system to provide an effective system for modifying or altering target sequences within the genome of a cell or organism. Also provided are novel effectors and endonuclease systems and elements comprising such systems, such as guide polynucleotide/endonuclease systems comprising an endonuclease. Compositions and methods are also provided for guide polynucleotide/endonuclease systems comprising at least one endonuclease, optionally covalently or non-covalently linked to, or assembled with, at least one additional protein subunit, and for compositions and methods for direct delivery of endonucleases as ribonucleotide proteins.

Figure 1A:
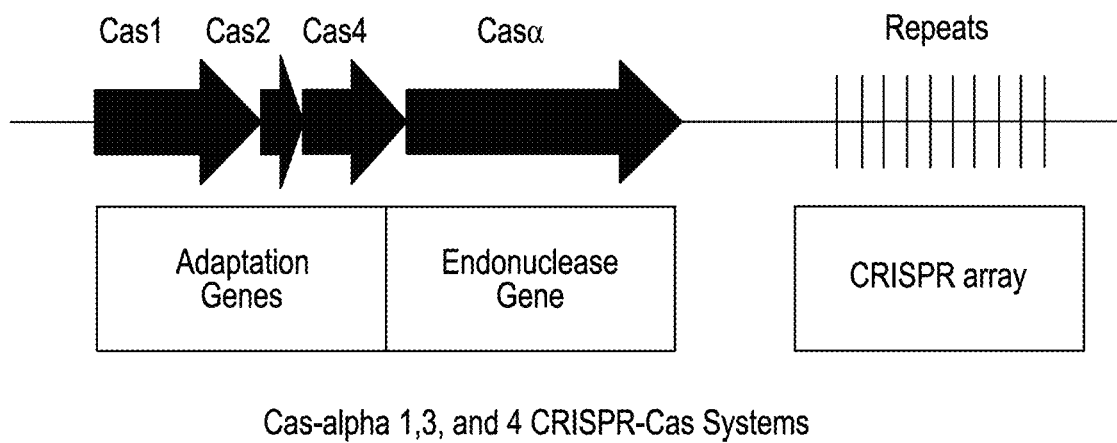

27 Claims, 60 Drawing Sheets
Specification includes a Sequence Listing.

(56) References Cited

U.S. PATENT DOCUMENTS

| | | |
|---|---|---|
| 10,329,547 B1 | 6/2019 | Cameron et al. |
| 2004/0231016 A1 | 11/2004 | Wang |
| 2007/0083945 A1 | 4/2007 | Byrum |
| 2007/0178593 A1 | 8/2007 | Miller |
| 2007/0199095 A1 | 8/2007 | Allen |
| 2008/0047031 A1 | 2/2008 | Tao |
| 2009/0070891 A1 | 3/2009 | Foley |
| 2009/0104700 A1 | 4/2009 | Samuel et al. |
| 2009/0133152 A1 | 5/2009 | Lyznik |
| 2010/0076057 A1 | 3/2010 | Sontheimer |
| 2010/0159598 A1 | 6/2010 | Jayakumar et al. |
| 2010/0311168 A1 | 12/2010 | Samuel et al. |
| 2010/0313293 A1 | 12/2010 | Albertsen |
| 2011/0035836 A1 | 2/2011 | Eudes et al. |
| 2011/0165679 A1 | 7/2011 | Gordon-Kamm |
| 2011/0203012 A1 | 8/2011 | Dotson |
| 2011/0247100 A1 | 10/2011 | Samboju et al. |
| 2012/0023619 A1 | 1/2012 | Samboju et al. |
| 2012/0023620 A1 | 1/2012 | Yau et al. |
| 2012/0244569 A1 | 9/2012 | Samuel et al. |
| 2013/0157369 A1 | 6/2013 | Miller |
| 2013/0198888 A1 | 8/2013 | Falco |
| 2013/0263324 A1 | 10/2013 | Lassner |
| 2014/0020131 A1 | 1/2014 | Bidney |
| 2014/0068797 A1 | 3/2014 | Doudna |
| 2014/0090113 A1 | 3/2014 | Cogan et al. |
| 2014/0096284 A1 | 4/2014 | Martin-Ortigosa et al. |
| 2014/0179006 A1 | 6/2014 | Zhang |
| 2014/0179770 A1 | 6/2014 | Zhang |
| 2014/0182012 A1 | 6/2014 | Eudes et al. |
| 2014/0186843 A1 | 7/2014 | Zhang |
| 2014/0186919 A1 | 7/2014 | Zhang |
| 2014/0186958 A1 | 7/2014 | Zhang |
| 2014/0189896 A1 | 7/2014 | Zhang |
| 2014/0227787 A1 | 8/2014 | Zhang |
| 2014/0234972 A1 | 8/2014 | Zhang |
| 2014/0242664 A1 | 8/2014 | Zhang |
| 2014/0242699 A1 | 8/2014 | Zhang |
| 2014/0242700 A1 | 8/2014 | Zhang |
| 2014/0242702 A1 | 8/2014 | Chen |
| 2014/0242703 A1 | 8/2014 | Samuel et al. |
| 2014/0248702 A1 | 9/2014 | Zhang |
| 2014/0256046 A1 | 9/2014 | Zhang |
| 2014/0273231 A1 | 9/2014 | Zhang et al. |
| 2014/0273232 A1 | 9/2014 | Zhang et al. |
| 2014/0273234 A1 | 9/2014 | Zhang |
| 2014/0273235 A1 | 9/2014 | Voytas |
| 2014/0310830 A1 | 10/2014 | Zhang |
| 2014/0335620 A1 | 11/2014 | Zhang |
| 2014/0342456 A1 | 11/2014 | Mali |
| 2014/0357530 A1 | 12/2014 | Zhang |
| 2014/0370558 A1 | 12/2014 | Mathis |
| 2015/0044191 A1 | 2/2015 | Liu |
| 2015/0044772 A1 | 2/2015 | Zhao |
| 2015/0045546 A1 | 2/2015 | Sisknys et al. |
| 2015/0059010 A1 | 2/2015 | Cigan |
| 2015/0067922 A1 | 3/2015 | Yang |
| 2015/0079681 A1 | 3/2015 | Yang |
| 2015/0082478 A1 | 3/2015 | Cigan et al. |
| 2015/0166980 A1* | 6/2015 | Liu ............... C12Y 305/04 435/227 |
| 2015/0167000 A1 | 6/2015 | Voytas |
| 2015/0167009 A1 | 6/2015 | D'Halluin |
| 2015/0225734 A1 | 8/2015 | Voytas |
| 2015/0284727 A1 | 10/2015 | Kim et al. |
| 2015/0291967 A1 | 10/2015 | Mathis |
| 2016/0024524 A1 | 1/2016 | Joung |
| 2016/0032297 A1 | 2/2016 | Deschamps et al. |
| 2016/0145631 A1 | 5/2016 | Voytas |
| 2016/0201072 A1 | 7/2016 | Cigan et al. |
| 2016/0208271 A1 | 7/2016 | Cigan et al. |
| 2016/0208272 A1 | 7/2016 | Cigan et al. |
| 2016/0251667 A1 | 9/2016 | Cigan et al. |
| 2016/0304846 A1 | 10/2016 | Liu et al. |
| 2016/0340746 A1 | 11/2016 | Makarov et al. |
| 2017/0022521 A1 | 1/2017 | Samuel et al. |
| 2017/0029880 A1 | 2/2017 | Fang et al. |
| 2017/0166912 A1 | 6/2017 | Brower-Toland |
| 2017/0183677 A1 | 6/2017 | Gao et al. |
| 2018/0002715 A1 | 1/2018 | Cigan et al. |
| 2018/0057832 A1 | 3/2018 | Li |
| 2018/0087104 A1 | 3/2018 | Joung et al. |
| 2018/0142263 A1 | 5/2018 | May et al. |
| 2018/0163203 A1 | 6/2018 | Bennett et al. |
| 2018/0230476 A1 | 8/2018 | Cigan et al. |
| 2018/0258417 A1 | 9/2018 | Cigan et al. |
| 2018/0258438 A1 | 9/2018 | Chaky et al. |
| 2018/0273960 A1 | 9/2018 | Cigan et al. |
| 2018/0282763 A1 | 10/2018 | Cigan et al. |
| 2018/0327785 A1 | 11/2018 | Cigan et al. |
| 2018/0334688 A1 | 11/2018 | Gersbach et al. |
| 2018/0346895 A1 | 12/2018 | Cigan et al. |
| 2018/0371479 A1 | 12/2018 | Cigan et al. |
| 2019/0040405 A1 | 2/2019 | Cigan et al. |
| 2019/0100745 A1 | 4/2019 | Cigan et al. |
| 2019/0100762 A1 | 4/2019 | Cigan et al. |
| 2019/0136248 A1 | 5/2019 | Cigan et al. |
| 2019/0161742 A1 | 5/2019 | Cigan et al. |
| 2019/0264232 A1 | 8/2019 | Hou et al. |
| 2020/0087640 A1 | 3/2020 | Doudna et al. |
| 2020/0172886 A1 | 6/2020 | Doudna et al. |
| 2020/0190487 A1 | 6/2020 | Zhang et al. |
| 2020/0224160 A1 | 7/2020 | Ding et al. |

FOREIGN PATENT DOCUMENTS

| | | |
|---|---|---|
| WO | 2007025097 | 3/2007 |
| WO | 2009042164 | 4/2009 |
| WO | 2010011961 | 1/2010 |
| WO | 2010077319 | 7/2010 |
| WO | 2011143124 | 11/2011 |
| WO | 2012129373 | 9/2012 |
| WO | 2012164565 | 12/2012 |
| WO | 2013019411 | 2/2013 |
| WO | 2013066423 | 5/2013 |
| WO | 2013068845 | 5/2013 |
| WO | 2013098244 | 7/2013 |
| WO | 2013112686 | 8/2013 |
| WO | 2013141680 | 9/2013 |
| WO | 2013142578 | 9/2013 |
| WO | 2013173535 | 11/2013 |
| WO | 2013176772 | 11/2013 |
| WO | 2014018423 | 1/2014 |
| WO | 2014065596 | 5/2014 |
| WO | 2014071006 | 5/2014 |
| WO | 2014089290 | 6/2014 |
| WO | 2014093479 | 6/2014 |
| WO | 2014093635 | 6/2014 |
| WO | 2014093694 | 6/2014 |
| WO | 2014093712 | 6/2014 |
| WO | 2014093768 | 6/2014 |
| WO | 2014144155 | 9/2014 |
| WO | 2014144761 | 9/2014 |
| WO | 2014150624 | 9/2014 |
| WO | 2014164466 | 10/2014 |
| WO | 2014165825 | 10/2014 |
| WO | 2014186686 | 11/2014 |
| WO | 2014194190 | 12/2014 |
| WO | 2015006294 | 1/2015 |
| WO | 2015006747 | 1/2015 |
| WO | 2015026883 | 2/2015 |
| WO | 2015026885 | 2/2015 |
| WO | 2015026886 | 2/2015 |
| WO | 2015026887 | 2/2015 |
| WO | 2015070083 | 5/2015 |
| WO | 2015071474 | 5/2015 |
| WO | 2015112896 | 7/2015 |
| WO | 2015131101 | 9/2015 |
| WO | 2015189693 | 12/2015 |
| WO | 2016007347 | 1/2016 |
| WO | 2016033298 | 3/2016 |
| WO | 2016040030 | 3/2016 |
| WO | 2016149352 | 9/2016 |
| WO | 2016186946 | 11/2016 |

(56) References Cited

FOREIGN PATENT DOCUMENTS

| WO | 2017015015 | | 1/2017 | |
|---|---|---|---|---|
| WO | 2017034971 | | 3/2017 | |
| WO | 2017062855 | | 4/2017 | |
| WO | 2017066497 | | 4/2017 | |
| WO | 2017070032 | | 4/2017 | |
| WO | 2017117395 | | 7/2017 | |
| WO | WO-2017117395 | A1 * | 7/2017 | ......... C12N 15/8241 |
| WO | 2017132239 | | 8/2017 | |
| WO | 2017155714 | | 9/2017 | |
| WO | 2017155715 | | 9/2017 | |
| WO | 2017155717 | | 9/2017 | |
| WO | 2017212264 | | 12/2017 | |
| WO | 2017218185 | | 12/2017 | |
| WO | 2018035250 | | 2/2018 | |
| WO | 2018172556 | | 9/2018 | |
| WO | 2018197495 | | 11/2018 | |
| WO | 2018197520 | | 11/2018 | |
| WO | 2019074841 | | 4/2019 | |
| WO | 2019084148 | | 5/2019 | |
| WO | 2019089808 | | 5/2019 | |
| WO | 2019168953 | | 9/2019 | |
| WO | 2019177978 | | 9/2019 | |
| WO | 2019178428 | | 9/2019 | |
| WO | 2019217354 | | 11/2019 | |
| WO | 2019217358 | | 11/2019 | |
| WO | 2019217816 | | 11/2019 | |
| WO | 2020086908 | | 4/2020 | |
| WO | 2020102659 | | 5/2020 | |

OTHER PUBLICATIONS

Ainley et al: "Trait stacking via targeted genome editing", Plant Biotechnology Journal, Aug. 19, 2013, pp. 1126-1134, vol. 11, No. 9.

Ali et al, "Efficient virus-mediated genome editing in plants using the CRISPR/Cas9 system", Molecular Plant (2015) 8(8) pp. 1288-1291.

Bae et al: "Cas-OFFinder: a fast and versatile algorithm that searches for potential off-target sites of Cas9 RNA-guided endonucleases", 2014, Bioinformatics vol. 30 No. 10, pp. 1473-1475.

Baltes et al, "DNA replicons for plant genome engineering", The Plant Cell (2014) 26(1):151-163.

Barrangou et al., CRISPR Provides Acquired Resistance Against Viruses in Prokaryotes, Science, 2007, pp. 1709-1712, vol. 315.

Barrangou et al., RNA-mediated programmable DNA cleavage, Nature Biotechnology, Sep. 2012, pp. 836-838, vol. 30, No. 9.

Barrangou et al., CRISPR-Cas sytems and RNA-guided interference, WIREs RNA, 2013, pp. 267-278, vol. 4.

Barrangou & Marraffini, "CRISPR-Cas systems: prokaryotes upgrade to adaptive immunity", Mol Cell 54:234-44 (Apr. 2014).

Beetham, A tool for functional plant genomics: Chimeric RNA/DNA oligonucleotides cause in vivo gene-specific mutations, Proc. Natl., Acad. Sci USA, Plant Biology, Jul. 1999, pp. 8774-8778, vol. 96.

Begemann et al: "Precise insertion and guided editing of higher plant genomes using Cpf1 CRISPR nucleases", bioRxiv, 2017, 109983.

Belhaj et al., Plant genome editing made easy: targeted mutagenesis in model and crop plants using the CRISPR/Cas system, Plant Methods, 2013, pp. 39-48, vol. 9.

Beurdeley et al: "Compact designer TALENs for efficient genome engineering", Nat Commun, Apr. 23, 2013, pp. 1-8, vol. 4, No. 1762.

Bollen et al: "How to create state-of-the-art genetic model systems: strategies for optimal CRISPR-mediated genome editing", Nucleic Acids Res, 2018, vol. 46 No. 13, pp. 6435-6454.

Bolotin et al: "Complete sequence and comparative genome analysis of the dairy bacterium Streptococcus thermophilus", Nature Biotechnology, 2004, vol. 22 No. 12, pp. 1554-1558.

BOLOTIN et al: "Clustered regularly interspaced short palindrome repeats (CRISPRs) have spacers of extrachromosomal origin", Microbiology, 2005, vol. 151, pp. 2551-2561.

Bondy-Denomy et al: "To acquire or resist: the complex biological effects of CRISPR-Cas systems", Trends in Microbiology, vol. 22 No. 4, Feb. 26, 2014, pp. 218-225.

Bortesi et al: "The CRISPR/Cas9 system for plant genome editing and beyond", Biotechnology Advances, vol. 33 No. 1, Jan. 1, 2015, pp. 41-52, XP055217852.

Briner et al: "Guide RNA functional modules direct Cas9 activity and orthogonality", Molecular Cell, vol. 56 No. 2, Oct. 16, 2014, pp. 333-339 (and Supplemental).

Burstein et al: "New CRISPR-Cas systems from uncultivated microbes", Nature 2017, vol. 542 pp. 237-241 (plus supplementary material).

Carte et al: "Cas6 is an endoribonuclease that generates guide RNAs for invader defense in prokaryotes", Genes and Development, 2008, vol. 22, pp. 3489-3496.

Cermak et al: A Multipurpose Toolkit to Enable Advanced Genome Engineering in Plants, The Plant Cell, 2017, vol. 29, pp. 1196-1217.

Chang et al., Genome editing with RNA-guided Cas9 nuclease in Zebrafish embryos, Cell Research, 2013, pp. 465-472, vol. 23.

Chen et al: "CRISPR-Cas12a target binding unleashes indiscrminate single-stranded Dnase activity", Science, 2018, vol. 360, pp. 436-439.

Cheng et al: "Multiplexed activation of endogenous genes by CRISPR-on, an RNA-guided transcriptional activator system", Cell Research, 2013, pp. 1163-1171, vol. 23.

Chen et al: "Highly efficient mouse genome editing by CRISPR ribonucleopeotein electroporation in zygotes", J Biol Chem, 2016, vol. 291, No. 28, pp. 14457-14467.

Cho et al., Targeted genome engineering in human cells with the Cas9 RNA-guided endonuclease, Nature Biotechnology, Mar. 2013, pp. 230-232, vol. 31, No. 3.

Cho et al: "Analysis of off-target effects of CRISPR/Cas-derived RNA-guided endonucleases and nickases", Genome Research, 2014, vol. 24, pp. 132-141.

Chylinski et al., The tracrRNA and Cas9 families of type II CRISPR-Cas immunity systems, RNA Biology, May 2013, pp. 726-737, vol. 10, No. 10.

Claesson M J et al: "Multireplicon genome architecture of Lactobacillus salivarius", PNAS, Apr. 1, 2006, pp. 6718-6723, vol. 103 No. 17.

Cong et al., Multiplex Genome Engineering Using CRISPR/Cas Systems, Sciencexpress Reports, Jan. 3, 2013, pp. 1-7, vol. 1.

Database: "CRISPR-associated endonuclease Cas9, Lactobacillus salivarius (strain UCC118): Q1WVK1_LACS1", UniProt, 2006.

Database ENA "Brevibacillus laterosporus GI-9 HNH endonuclease family protein", XP002788584, retrieved from EBI Database Accession No. CCF15452, 2012.

Database UniProt "RecName: Full-CRISPR-associated endonuclease Cas9" retrieved from EBI accession No. UNIPROT:H0UDA8, 2012.

Database: "cas9-CRISPR-associated endonuclease CAs9—Bacillus cereus VD131—cas9 gene & protein", UniProt database entry: R8LDU5, 2013.

Database: hypothetical protein [Lactobacillus reuteri]: NCBI Reference Sequence WP_019251774.1, 2013.

Database: "Lactobacillus reuteri TD1, complete genome, NCBI Reference Sequence: NC_021872.1", 2014.

Database: KGF29309 CRISPR-associated protein Cas9 [Prevotella histicola JCM 15637 = DNF00424], NCBI GenPept Jul. 9, 2014.

Database RefSEQ NCBI, database accession WP_010710291.1, "Type II CRISPR-RNA-guided endonuclease Cas9 [Enterococcus faecalis]", 2015.

Database RefSEQ NCBI, database accession WP_023519017, "Type II CRISPR-RNA-guided endonuclease Cas9 [Enterococcus mundtii]", 2015.

Database RefSEQ NCBI, database accession WP_031455829, "Type II CRISPR-RNA-guided endonuclease Cas9 [Flavobacterium chungangense]", 2015.

Database RefSEQ NCBI, database accession WP_048395223, "Type II CRISPR-RNA-guided endonuclease Cas9 [Pseudomonas lini]", 2015.

(56) References Cited

OTHER PUBLICATIONS

Database UniProt "RecName: Full-CRISPR-associated endonuclease Cas9" retrieved from EBI accession No. UNIPROT:A0A0F4LLE0, 2015.
Database: "Using Cpf1 for CRISPR. Benchling", XP55396832, 2015.
Elitza Deltcheva et al., CRISPR RNA maturation by trans-encoded small RNA and host factor RNase III, Nature, Mar. 31, 2011, pp. 602-607, vol. 471.
D'Halluin et al., Targeted molecular trait stacking in cotton through targeted double-strand break induction, Plant Biotechnology Journal, pp. 933-941, vol. 11, Jun. 18, 2013.
Dicarlo et al., Genome engineering in *Saccharomyces cerevisiae* using CRISPR-Cas systems, Nucleic Acids Research, Mar. 4, 2013, pp. 4336-4343, vol. 41, No. 7.
Djukanovic et al: "Male-sterile maize plants produced by targeted mutagenesis of the cytochrome P450-like gene (MS26) using a re-designed I-CreI homing endonuclease", The Plant Journal, Nov. 5, 2013, pp. 888-899, vol. 76, No. 5.
Djukic M et al: "Genome seqence of a Brevibacillus laterosporus LMG 15441, a pathogen of invertebrates", J Bacteriology, American Society for Micorbiology, US, 2011 vol. 193 No. 19, pp. 5535-5536.
Dong et al: "The crystal structure of Cpf1 in complex with CRISPR RNA", Nature, 2016, doi:10.1038/nature17944.
Marraffini et al., CRISPR interference: RNA-directed adaptive immunity in bacteria and archaea, Nat Rev Genet, Mar. 2010, pp. 181-190, vol. 11(3).
Martin-Ortigosa et al: "Mesoporous silica nanoparticle-mediated intracellular Cre protein delivery for maize genome editing via IoxP sigte excision", Plant Physio, vol. 164, Issue 2, Feb. 2014, pp. 537-547.
Martin-Ortigosa et al: "Proteolistics: a biolistic method for intracellular delivery of proteins", Transgenic Res, vol. 23, Aug. 5, 2014, pp. 743-756.
Maruyama et al, "Increasing the efficiency of precise genome editing with CRISPR-Cas9 by inhibition of nonhomologous end joining", Nature Biotech (2015) 33(5) pp. 538-542 (and Corrigendum).
Miao et al., Targeted mutagenesis in rice using CRISPR-Cas System, Cell Research, 2013, pp. 1233-1236, vol. 23.
Miller et al., A TALE nuclease architecture for efficient genome editing, Nature Biotechnology, Feb. 2011, pp. 143-148, vol. 29.
Mojica et al., Biological significance of a family of regularly spaced repeats in the genomes of Archaea, Bacteria and mitochondria, Molecular Microbiology, May 2000, pp. 244-246, vol. 36.
Naito et al: "CRISPRdirect: software for designing CRISPR/Cas guide RNA with reduced off-target sites", Bioinformatics, 2014, vol. 31 No. 7 pp. 1120-1123.
Nam et al: "Cas5d Protein Processes Pre-crRNA and Assembles into a Cascade-like Interference Complex in Subtype I-C/Dvulg CRISPR-Cas System", Structure, 2012, vol. 20 pp. 1574-1584.
Nekrasov et al., Targeted mutagenesis in the model plant Nicotiana benthamiana using Cas9 RNA-guided endonuclease, Nature Biotechnology, pp. 691-693, vol. 31, No. 8, Aug. 2013.
Nishimasu et al: "Structures and mechanisms of CRISPR RNA-guided effector nucleases", Cuff Opin Structural Biol, 2017, vol. 43, pp. 68-78.
Obrien et al: "GT-Scan: identifying unique genomic targets", Bioinformatics, 2014, vol. 30 No. 8 pp. 2673-2678.
Oh et al: "CRISPR-Cas9-assisted recombineering in Lactobacillus reuteri", Nucleic Acids Research, vol. 42 No. 17, Sep. 29, 2014, p. e131 (and Supplemental).
Ow: "Recombinase-mediated Gene Stacking as a Transformation Operating System", J Integrative Plant Biol 2011, vol. 53 No. 7 pp. 512-519.
Pacher et al: "From classical mutagenesis to nuclease-based breeding—directing natural DNA repair for a natural end-product", Plant J, 2017, vol. 90, pp. 819-833.

Pattanayak et al: "High-throughput profiling of off-target DNA cleavage reveals RNA-programmed Cas9 nuclease specificity", Nature Biotech, 2013, vol. 31 No. 9, pp. 839-843.
Paul et al: "CRISPR/Cas9 for plant genome editing: accomplishments, problems and prospects", Plant Cell Reports, Springer International, DE, vol. 35, No. 7, Apr. 25, 2016, pp. 1417-1427.
Peng et al, "A Synthetic arabinose-inducible promoter confers high levels of recombinant protein expression in hyperthermophilic Archaeon sulfolobus islandicus", Appl Environ Microbiol, Aug. 2012, pp. 5630-5637, vol. 78 No. 16.
Phillips, "The challenge of gene therapy and DNA delivery", Pharm Pharmacology, 2001, 1169-1174 vol. 53.
Podevin et al., Site-directed nucleases: a paradigm shift in predictable, knowledge-based plant breeding, Trends in Biotechnology, Jun. 2013, pp. 375-383, vol. 31, No. 6.
Puchta et al: "Gene replacement by homologous recombination in plants", Plant Mol Biol, 2002, vol. 48 pp. 173-182.
Puchta et al: "Synthetic nucleases for genome engineering in plants: prospects for a bright future", The Plant Journal, 2014, vol. 78, pp. 727-741.
Lei S. Qi et al., Repurposing CRISPR as an RNA-Guided Platform for Sequence-Specific Control of Gene Expression, Cell, Feb. 28, 2013, pp. 1173-1183, vol. 152(5).
Que et al: "Trait stacking in transgenic crops: Challenges and opportunities", GM Crops 2010, vol. 1 Issue 4, pp. 220-229.
Que et al: "Maize transformation technology development for commercial event generation", Frontiers in Plant Science, vol. 5, Aug. 5, 2014, pp. 12-15.
Que, "Repurposing Macromolecule Delivery Tools for Plant Genetic Modification", 2019, Methods and Protocols, Methods in Molecular Biology, vol. 1864, Chapter One.
Quinn et al, "A streamlined method for the production, screening, and application of sgRNAs for CRISPR/Cas gene editing", Molecular Therapy (2014) vol. 22 Supplement 1 p. S128 #336.
Ramakrishna et al: "Gene disruption by cell-penetrating peptide-mediated delivery of Cas9 protein and guide RNA", Genome Res 24:1020-27 (Apr. 2014).
Ramalingam et al., A CRISPR way to engineer the human genome, Genome Biology, 2013, 4 pages, vol. 14 (Feb 26, 2013).
Rath et al: "Type I-E CRISPR-Cas system as an immune system in a eukaryote", bioRxiv, 2018, doi10.1101/357301.
Reeks et al., "CRISPR interference: a structural perspective.", 2013, Biochem J, pp. 155-166, vol. 453.
Relic et al., Interaction of the DNA modifying proteins VirD1 and VirD2 of Agrobacterium tumefaciens: Analysis by subcellular localization in mammalian cells, Proc Natl Acad Sci, 1998, 95:9105-9110.
Retallack et al, "A single base pair mutation changes the specificities of both a transcription activation protein and its binding site", PNAS, Oct. 1993, pp. 9562-9565, vol. 90.
Rueda et al, "Mapping the sugar dependency for rational generation of a DNA-RNA hybrid-guided Cas9 endonuclease", Nature Communications, 2017, 8:1610 (and Supplemental).
Rusk et al: "New kid on the CRISPR block", Nature Methods, 2015, vol. 12 No. 12 p. 1117.
Sadowski, Site-specific genetic recombination: hops, flips, and flops, FASEB, 1993, pp. 760-767, vol. 7.
Sanjana et al., A Transcription Activator-Like Effector (TALE) Toolbox for Genome Engineering, Nat. Protoc, 2012, pp. 171-192, vol. 7(1).
Sanozky-Dawes et al: "Occurrence and activity of a type II CRISPR-Cas system in Lactobacillus gasseri", Microbiology, vol. 161, No. 9, Sep. 1, 2015, pp. 1752-1761.
Sapranauskas et al., The *Streptococcus thermophilus* CRISPR/Cas system provides immunity in *Escherichia coli* Nucleic Acids Research, Aug. 2011, pp. 9275-9282, vol. 39, No. 21.
Sauer, Site-specific recombination: developments and applications, Current Opinion in Biotechnology, 1994, pp. 521-527, vol. 5.
Schaeffer et al: "The expanding footprint of CRISPR/CAs9 in the plant sciences", Plant Cell Reports, Springer International, DE, vol. 35, No. 7, Apr. 30, 2016, pp. 1451-1468.
Shah et al: "Protospacer recognition motifs", RNA Biology, May 1, 2013, pp. 1547-6286, vol. 10 No. 5.

(56) References Cited

OTHER PUBLICATIONS

Shan et al., Targeted genome modification of crop plants using a CRISPR-Cas system, Nature Biotechnology, Aug. 2013, pp. 686-688, vol. 31, No. 8 (and Supplemental).
Shen et al., Generation of gene-modified mice via Cas9/RNA-mediated gene targeting, Cell Research, May 2013, pp. 720-723, vol. 23, No. 5.
Shmakov et al: "Diversity and evolution of class 2 CRISPR-Cas systems", Nat Rev Micro, 2017, advance publication, 14 pp.
Shukla et al: Precise genome modificaiton in the crop species *Zea mays* using zinc-finger nucleases, Nature, Apr. 29, 2009, p. 437, vol. 459, No. 7245.
Sinkunas et al: "Cas3 is a single-stranded DNA nuclease and ATP-dependent helicase in the CRISPR/Cas immune system", EMBO, vol. 30 No. 7, Apr. 2011, pp. 1335-1342.
Sinkunas et al: "In vitro reconstitution of Cascade-mediated CRISPR immunity in *Streptococcus thermophilus*", EMBO Journal, 2013, vol. 32, pp. 385-394.
Song et al: "Development and evaluation of SoySNP50K, a high density genotyping array for soybean", PLOS One 2013, vol. 8 Issue 1 e54985.
Sontheimer et al: "Cas9 gets a classmate", Nature Biotech, 2015, vol. 33 No. 12, pp. 1240-1241.
Martin Jinek et al., A Programmable Dual-RNA-Guided DNA Endonuclease in Adaptive Bacterial Immunity, Science, Aug. 17, 2012, pp. 816-821, vol. 337.
Martin Jinek et al., RNA-programmed genome editing in human cells, eLife, 2013, e00471, pp. 1-9.
Johnson et al., A rapid assay to quantify the cleavage efficiency of custom-designed nucleases in planta, Plant Mol Biol, 2013, pp. 207-221, vol. 82.
Jore et al: "Structural basis for CRISPR RNA-guided DNA recognition by Cascade", Nature Structural & Mol Biol, 2011, vol. 18 No. 5, pp. 529-537 (and Supplemental).
Jung, "Challenges in Wide Implementation of Genome Editing for Crop Improvement", JCropSciBiotech, 2017, vol. 20 No. 2 pp. 129-135.
Kanchiswamy C N et al: "Non-GMO genetically edited crop plants", Trends in Biotechnology, vol. 33 No. 9, Sep. 1, 2015, XP002765281.
Karvelis et al: "Rapid characterization of CRISPR-Cas9 protospacer adjacent motif sequence elements", Genome Biology, vol. 16 No. 253, Nov. 19, 2015.
Karvelis et al: "PAM recognition by miniature CRISPR-Cas14 triggers programmable double-stranded DNA cleavage", bioRxiv, 2019, 654897.
Kim et al: "Highly efficient RNA-guided genome editing in human cells via delivery of purified Cas9 ribonucleoproteins", Genome Res, vol. 24, Apr. 2, 2014, pp. 1012-1019.
Kim Goon-Bo et al: "Isolation and characterization of Medicago truncatula U6 promoters for construction of small hairpin RNA-mediated gene silencing vevctors", Plant Molecular Biology Reporter, vol. 31 No. 3, Jun. 2014, pp. 581-593.
Hyeran Kim et al: "Targeted genome editing for crop improvement", Plant Breeding and Biotechnology, vol. 3, No. 4, Dec. 30, 2015, pp. 283-290.
Kim et al: "Targeted Genome Editing for Crop Improvement", Plant Breed Biotech, 2015, vol. 3 No. 4 pp. 283-290.
Kim et al: "CRISPR/Cpf1-mediated DNA-free plant genome editing", Nature Communications, 2017, 8:14406 | DOI: 10.1038/ncomms14406.
Kocak et al: "Increasing the specificity of CRISPR systems with engineered RNA secondary structures", Nature Biotech, 2019, vol. 37, pp. 657-666.
Koo et al: "Measuring and Reducing Off-Target Activities of Programmable Nucleases Including CRISPR-Cas9", Molecules and Cells, 2015_vol. 38 No. 6 pp. 475-481.
Koonin et al., CRISPR-CAS Evolution of an RNA-based adaptive immunity system in prokaryotes, RNA Biology, May 2013, pp. 679-686, vol. 10:5.

Koonin et al: "Diversity, classification and evolution of CRISPR-Cas systems", Curr Opinion Microbiol, 2017, vol. 37, pp. 67-78.
Kumar et al: "The CRISPR-Cas system for plant genome editing: advances and opportunities", Journal of Experimental Botany, vol. 66, No. 1, Nov. 4, 2014, pp. 47-57.
Kuscu et al: "Genome-wide analysis reveals characteristics of off-target sites bound by the Cas9 endonuclease", Nature Biotech, 2014, vol. 32 No. 7, pp. 677-683.
Leblanc, C et al: "Increased efficiency of targeted mutgenesis by CRISPR/Cas9 in plants using heat stress", The Plant Journal, 2018, vol. 93, pp. 377-386.
Leenay et al: "Identifying and visualizing functional PAM diversity across CRISPR-Cas systems", Molecular Cell, Cell Press, Cambridge, MA, US, vol. 62 No. 1, Mar. 31, 2016, pp. 137-147 and Supplemental.
Lee et al: "Nuclease target site selection for maximizing on-target activity and minimizing off-target effects in genome editin", Molecular Therapy: The Journal of the American Society of Gene Therapy, 2016, vol. 24 No. 3, pp. 475-487.
Leonard et al: "Complete genome sequences of Lactobacillus johnsonii Strain N6.2 and Lacctobacillus reuteri Strain TD1", Genome Announcements, vol. 2 No. 3, May 8, 2014.
Li et al: "Varied transcriptional efficiencies of multiple *Arabidopsis* U6 small nuclear RNA genes", Journal of Integrative Plant Biology,Feb. 2007, pp. 222-229, vol. 49 No. 2.
Li et al: "Site-Specific Integration of Transgenes in Soybean via Recombinase-Mediated DNA Cassette Exchange", Plant Physiology 2009, vol. 151 pp. 1087-1095.
Li et al., "In vivo genome editing restores hemostasis in a mouse model of hemophilia", Nature, 2011, pp. 217-221, vol. 475 No. 7355.
Li et al. High-efficiency TALEN-based gene editing produces disease-resistant rice. Nat Biotechnol. May 7, 2012, pp. 390-392, vol. 30 No. 5.
Jian-Feng Li et al., Multiplex and homologous recombination—mediated genome editing in *Arabidopsis* and Nicotiana benthamiana using guide RNA and Cas9, Nature Biotechnology, Aug. 2013, pp. 688-691, vol. 31, No. 8.
Li, "Comparative Analysis of the Base Compositions of the Pre-mRNA 3' Cleaved-Off Region and the mRNA 3' Untranslated Region Relative to the Genomic Base Composition in Animals and Plants" PLOS One, Jun. 2014, vol. 9 Issue 6, e99928.
Li et al: "Cas9-guide RNA directed genome editing in soybean", Plant Physiology, vol. 169 No. 2, Oct. 2015, pp. 960-970, XP002765282.
Li et al: "Synthesis-dependent repair of Cpf1-induced double strand DNA breaks enables targeted gene replacement in rice", J Expt Botany, 2018, vol. 69 No. 20 pp. 4715-4721.
Liang et al: "Targeted mutagenesis in *Zea mays* using TALENs and the CRISPR/Cas system", Journal of Genetics and Genomics, Dec. 14, 2013, pp. 63-68, vol. 41, No. 2.
Liang et al: 'Rapid and highly efficient mammalian cell engineering via Cas9 protein transfection, J Biotechnology, May 21, 2015, vol. 208, pp. 44-53.
Liang et al: "Efficient DNA-free genome editing of bread wheat using CRISPR/Cas9 ribonucleoprotein complexes", Nature Communications, 2017, vol. 8 14261.
Lieber et al., The Mechanism of Double-Strand DNA Break Repair by the Nonhomologous DNA End Joining Pathway, Annu Rev Biochem, 2010, pp. 181-211, vol. 79.
Lin et al: "Enhanced homology-directed human genome engineering by controlled timing of CRISPR/Cas9 delivery", eLIFE, 3:e04766, Dec. 15, 2014.
Liu et al: "CasX enzymes comprise a distinct family of RNA-guided genome editors", Nature 2019, vol. 566, pp. 218-240 (incl. supplementary material).
Luo, et al: "Non-transgenic plant genome editing using purified sequence-specific nucleases", Mol Plant, vol. 8, Jun. 11, 2015, 1425-1427.
Ming MA et al, A Guide RNA Sequence Design Platform for the CRISPR/Cas9 System for Model Organism Genomes, BioMed Research International, 2013, 4 pages, Article ID 270805.

(56) References Cited

OTHER PUBLICATIONS

Maeder et al., CRISPR RNA—guided activation of endogenous human genes, Nature Methods, Oct. 2013, pp. 977-979, vol. 10, No. 10.
Maier et al: "An Active Immune Defense with a Minimal CRISPR (Clustered Regularly Interspaced Short Palindromic Repeats) RNA and without the Cas6 Protein", J Biol Chem, 2015 vol. 290 No. 7 pp. 4192-4201.
Makarova et al., Evolution and classification of the CRISPR-Cas systems, Nat Rev Microbiol, Jun. 2011, pp. 467-477, vol. 9(6).
Makarova et al: "The basic building blocks and evolution of CRISPR-Cas systems", Biochem Soc Trans, 2013, vol. 41 Part 6, pp. 1392-1400 (and Supplemental).
Makarova et al: "An updated evolutionary classification of CRISPR-Cas systems", Nat Rev Micro, 2015, vol. 13, doi:10.1038/nrmicro3569.
Mali et al., CAS9 transcriptional activators for target specificity screening and paired nickases for cooperative genome engineering, Nat. Biotechnol., Sep. 2013, pp. 833-838, vol. 31(9).
Mali et al., RNA-Guided Human Genome Engineering via Cas9, Sciencexpress, Feb. 15, 2013, pp. 823-826, vol. 15, 339(6121).
Mandal et al: "Efficient ablation of genes in human hematopoietic stem and effector cells using CRISPR/Cas9", Cell Stem Cell, 2014, vol. 15 No. 5, pp. 643-652.
Mao et al., Comparison of nonhomologous end joining and homologous recombination in human cells, DNA Repair, 2008, 7:1765-1771.
Mao et al., Application of the CRISPR-Cas System for Efficient Genome Engineering in Plants, Molecular Plant, Nov. 2013, pp. 2008-2011, vol. 6, No. 6.
Marraffini et al, CRISPR Interference Limits Horizontal Gene Transfer in *Staphylococci* by Targeting DNA, Science, Dec. 19, 2008, pp. 1843-1845, vol. 322(5909).
Doudna & Charpentier, "The new frontier of genome engineering with CRISPR-Cas9", Sci 346(6213):1258096 (2014).
Dow et al: "Inducible in vivo genome editing with CRISPR-Cas9", Nature Biotechnology, vol. 33, No. 4, Feb. 18, 2015, pp. 390-394.
Ellegaard et al: "Extensive intra-phylotype diversity in lactobacilli and bifidobacteria from the honeybee gut", MBC Genomics, vol. 16, No. 1, Apr. 11, 2015 p. 284.
Endo et al: "Toward establishing an efficient and versatile gene targeting system in higher plants", Biocatalysis and Ag Biotech, 2014, vol. 3 pp. 2-6.
Endo et al: "Efficient targeted mutagenesis of rice and tobacco genomes using Cpf1 from Francisella novicida", Nature Scientific Reports, 2016, 6:38169.
Esvelt et al: "Orthogonal Cas9 proteins for RNA-guided gene regulation and editing", Nature Methods, Sep. 29, 2013, pp. 1116-1121, vol. 10 No. 11.
Fagerlund et al: "The Cpf1 CRISPR-Cas protein expands genome-editing tools", Genome Biology, 2015, vol. 16, No. 251.
Feng et al., Efficient genome editing in plants using a CRISPR/Cas system, Cell Research, 2013, pp. 1229-1232, vol. 23.
Fichtner et al: "Precision genetic modifications: a new era in molecular biology and crop improvement", Planta 239:921-39 (2014).
Florez et al: "Enhanced somatic embryogenesis in Theobroma cacao using the homologous Baby Boom transcription factor", BMC Plant Biol, 2015, vol. 15, No. 121.
Fonfara et al: "The CRISPR-associated DNA-cleaving enzyme Cpf1 also processes precursor CRISPR RNA", Nature, vol. 532, Apr. 20, 2016, pp. 517-521.
Yanfang Fu et al., Improving CRISPR-Cas nuclease specificity using truncated guide RNAs, Nature Biotechnology, Mar. 2014, vol. 32, No. 3.
Fujita et al.,"The point mutation in the promoter region and the single nucleotide polymorphism in exon 1 of the cytokeratin 19 gene in human lung cancer cell lines" Lung Cancer, Dec. 2001, vol. 34 No. 3 pp. 387-394.
Funke et al., Structural Basis of Glyphosate Resistance Resulting from the Double Mutation Thr 97 Ile and Pro101 Ser in 5-Enolpyruvylshikimate-e-phosphate synthase from *Escherichia coli*. J Biol Chem vol. 284 No. 15 pp. 9854-9860, Apr. 10, 2009.
Gabriel et al: "An unbiased genome-wide analysis of zinc-finger nuclease specificity", Nature Biotech, 2011, vol. 29 No. 9, pp. 816-823.
Gaj et al., ZFN, Talen and CRISPR/Cas-based methods for genome engineering, Trends Biotechnology, Jul. 2013, pp. 397-405, vol. 31(7).
Ganal et al: "A large maize (*Zea mays* L.) SNP genotyping array: development and germplasm genotyping, and genetic mapping to compare with B73 reference genome", PLOS One, vol. 6, No. 12, Dec. 8, 2011, p. e28334.
Gao et al: "DNA-guided genome editing using the Natronobacterium gregoryi Argonaute", Nature Biotech, 2016, doi:10.1038/nbt.3547.
Gardlik et al., "Vectors and delivery systems in gene therapy", Med Sci Monit, 2005, RA110-121, vol. 11 No. 14.
Garneau et al., The CRISPR/Cas bacterial immune system cleaves bacteriophase and plasmid DNA, Nature, 2010, pp. 67-71, vol. 468.
Garside et al: "Cas5d processes pre-crRNA and is a member of a larger family of CRISPR RNA endonucleases", RNA, 2012, vol. 18 pp. 2020-2028.
Giedrius Gasiunas et al., Cas9-crRNA ribonucleoprotein complex mediates specific DNA cleavage for adaptive immunity in bacteria, PNAS, Sep. 4, 2012, e2579-2586.
Gilbert et al., CRISPR-Mediated Modular RNA-Guided Regulation of Transcription in Eukaryotes, Cell, Jul. 18, 2013, pp. 442-451, vol. 154(2).
Gilles et al: "Efficient CRISPR-mediated gene targeting and transgene replacement in the beetle Tribolium castaneum", The Company of Biologists, 2015, vol. 142, pp. 2832-2839.
Gong et al., DNA unwinding is the primary determinant of CRISPR-Cas9 activity, 2018, Cell Reports, pp. 359-371, vol. 22 Issue 9.
Gratz et al., Genome Engineering of *Drosophila* with the CRISPR RNA-Guided Cas9 Nuclease, Aug. 2013, Genetics, pp. 1029-1035, vol. 194.
Grissa I et al: "CRISPRFinder: a web tool to identify clustered regularly interspaced short palindromic repeats", Nucleic Acids Research, Information Retrieval Ltd, GB, May 31, 2007, pp. W52-W57, vol. 35.
Guilinger et al: "Broad specificity profiling of TALENs results in engineered nucleases with improved DNA-cleavage specificity", Nature Methods, 2014, vol. 11 No. 4, pp. 429-435.
Guillinger Etl Al.: "Fusion of catalytically inactive Cas9 to Fok1 nuclease improves the specificity of genome modification", Nat Biotech 32(6):577-83 (2014).
Daniel H. Haft et al., A Guild of 45 CRISPR-Associated (Cas) Protein Families and Multiple CRISPR/Cas Subtypes Exist in Prokaryotic Genomes, PLoS Computational Biol, Nov. 11, 2005.
Hale et al. , RNA-Guided RNA Cleavage by a CRISPR RNA-Cas Protein Complex, Cell, Nov. 25, 2009, pp. 945-956, vol. 139.
Harrington et al: "Programmed DNA destruction by miniature CRISPR-Cas14 enzymes", Science, 2018, vol. 362 pp. 839-842.
Haurwitz et al., Sequence- and Structure-Specific RNA Processing by a CRISPR Endonuclease, Science, Sep. 10, 2010, pp. 1355-1358, vol. 329.
Heler, "Cas9 specifies functional viral targets during CRISPR-Cas adaptation", Nature, 2015, vol. 519, p. 199.
Hochstrasser et al: "Cutting it close: CRISPR-associated endoribonuclease structure and function", TIBS, 2014 vol. 40 No. 1 pp. 58-66.
Horvath et al., Diversity, Activity, and Evolution of CRISPR Loci in *Streptococcus thermophilus*, Journal of Bacteriology, Feb. 2008, pp. 1401-1412, vol. 190,No. 4.
Horvath et al., CRISPR/Cas, the Immune System of Bacteria and Archaea, Science, Jan. 8, 2010, pp. 167-170, vol. 327.
Houdebine, "The methods to generate transgenic animals and to control transgene expression", J Biotech, 2002,145-160, vol. 98.
Hou et al., Efficient genome engineering in human pluripotent stem cells using Cas9 from Neisseria meningitides, PNAS, Sep. 24, 2013, pp. 15644-15649, vol. 110, No. 39.

(56) References Cited

OTHER PUBLICATIONS

Hsu et al., DNA targeting specificity of RNA-guided Cas9 nucleases, Nature Biotechnology, Sep. 2013, pp. 827-834, vol. 31, No. 9.

Huang et al: "Circularly permuted and PAM-modified Cas9 variants broaden the targeting scope of base editors", Nature Biotech, 2019, vol. 37, pp. 626-631.

Husaini et al: "Vehicles and ways for efficient nuclear transformation in plants", GM Crops, 2010, vol. 1 No. 5, pp. 276-287.

Hwang et al., Efficient In Vivo Genome Editing Using RNA-Guided Nucleases, Nature Biotech, Mar. 2013, pp. 227-229, vol. 31, No. 3.

Hyun et al., "Site-directed mutagenesis in *Arabisopsis thaliana* using divided tissue-targeted RGEN of the CRISPR/Cas was system to generate heritable null alleles", Planta, Jan. 2015, vol. 241 No. 1, pp. 271-284.

Jacobs et al, "Targeted genome modifications in soybean with CRISPR/Cas9", BMC Biotechnology, Mar. 2015, vol. 15 No. 1, 10 pages.

Jacoby et al., Expanding LAGLIDADG endonuclease scaffold diversity by rapidly surveying evolutionary sequence space, Nucleic Acids Research, Feb. 2012, pp. 4954-4964, vol. 40, No. 11.

Jiang et al., "Demonstration of CRISPR/Cas9/sgRNA-mediated targeted gene modificaiton in *Arabidopsis*, tobacco, sorghum and rice", Nucleic Acids Research, Sep. 2, 2013, pp. e188-e188, XP055219328, vol. 41 No. 20.

Jiang et al., RNA-guided editing of bacterial genomes using CRISPR-Cas systems, Nature Biotechnology, Mar. 2013, pp. 233, vol. 31, No. 3.

Wenzhi Jiang et al., "Efficient CRISPR/Cas9-mediated gene edigin in *Arabidopsis thalian* and inheritance of modified genes in the T2 and T3 generations", PLOS One, vol. 9 No. 6, Jun. 11, 2014, p. e99225, XP055219594.

Jiang et al: "CRISPR-Cas: New tools for genetic manipulations of bacterial immunity systems", Annual Review of Microbiology, vol. 69, No. 1, Jul. 22, 2015, pp. 209-228.

Sponsored Paper "A streamlined method for the production, screening, and application of sgRNAs for CRISPR/Cas9 gene editing", BioTechniques (2014) 57(3) 157.

Stemmer et al: "CCTop: An Intuitive, Flexible and Reliable CRISPR/Cas9 Target Prediction Tool", PLOS One, 2015, vol. 10 No. 4 e0124633.

Strauss, "Zinc Fingers, TAL Effectors, or Cas9-Based DNA Binding Proteins: What's Best for Targeting Desired Genome Loci?", MolecularPlant, Sep. 2013, vol. 6 No. 5 pp. 1384-1387.

Subburaj et al: "Site-directed mutagenesis in Petunia 3 hybrida protoplast system using direct delivery of purified recombinant Cas9 ribonucleoproteins", Plant Cell Rep, 2016 vol. 35 pp. 1535-1544.

Sun et al: "Expanding the biotechnology potential of lactobacilli through comparative genomics of 213 strains and associated genera", Nature Communications, Nature Publishing Group, UK, vol. 6, Sep. 29, 2015, p. 7.

Svitashev et al: "Targeted mutagenesis, precise gene editing, and site-specific gene insertion in maize using Cas9 and guide RNA", Plant Physiology, vol. 169, No. 2, Aug. 12, 2015, pp. 931-945.

Svitashev et al: "Genome editing in maize directed by CRISPR-Cas9 ribonucleoprotein complexes", Nature Communications, 2016, vol. 7 13274.

Tang et al: "A CRISPR-Cpf1 system for efficient genome editing and transcriptional repression in plants", Nature Plants, 2017, vol. 3, Article No. 17018.

Tinland et al., The T-DNA-linked VirD2 protein contains two distinct functional nuclear localization signals, Proc. Natl. Acad. Sci, Aug. 1992, pp. 7442-7446, vol. 89.

Ui-Tei et al, "Functional dissection of siRNA sequence by systematic DNA substitution: modified siRNA with a DNA seed arm is a powerful tool for mammalian gene silencing with significantly reduced off-target effect" Nucleic Acid Res. 2008, pp. 2146-2151, vol. 36 No. 7.

Unniyampurath et al: "RNA Interference in the Age of CRISPR: Will CRISPR Interfere with RNAi?", 2016, International J Mol Sci, vol. 17 No. 291, 15 pp.

Van Der Oost, New Tool for Genome Surgery, Science, Feb. 15, 2013, pp. 768-770, vol. 339.

Voytas, Plant Genome Engineering with Sequence-Specific Nucleases, Annual Review of Plant Biology, pp. 327-350, vol. 64, Mar. 1, 2013.

Wang et al., Hairpin RNAs derived from RNA polymerase II and polymerase III promoter-directed transgenes are processed differently in plants, RNA, May 2008, pp. 903-13, vol. 14 No. 5.

Wang et al., Targeted gene addition to a predetermined site in the human genome using a ZFN-based nicking enzyme, Genome Research, 2012, pp. 1316-1326.

Haoyi Wang et al., One-Step Generation of Mice Carrying Mutations in Multiple Genes by CRISPR/Cas-Mediated Genome Engineering, Cell, May 9, 2013, pp. 910-918, vol. 153(4).

Wang et al: "Multiplex Gene Editing in Rice Using the CRISPR-Cpf1 System", Molecular Plant, 2017, pp. 1-3.

Wei et al., Physical and Genetic Structure of the Maize Genome Reflects Its Complex Evolutionary History, PLoS Genetics, Jul. 2007, vol. 3 Issue 7, pp. 1254-1263.

Westra et al: "CRISPR immunity relies on the consecutive binding and degradation of negatively supercoiled invader DNA by Cascade and Cas3", Mol Cell, Apr. 19, 2012,pp. 595-605, vol. 46 No. 5.

Wiedenheft et al., RNA-guided genetic silencing systems in bacteria and archaea, Nature, Feb. 16, 2012, pp. 331-338, vol. 482.

Wierzbicki et al: "Noncoding Transcription by RNA Polymerase Pol IVb/Pol V Mediates Transcriptional Silencing of Overlapping and Adjacent Genes", Cell, 2008, vol. 135, pp. 635-648.

Wolter et al: "Knocking out consumer concerns and regulator's rules: efficient use of CRISPR/Cas ribonucleoprotein complexes for genome editing in cereals", Genome Biology, 2017, vol. 18 No. 43.

Woo et al: "DNA-free genome editing in plants with preassembled CRISPR-Cas9 ribonucleoproteins", Nature Biotechnology, vol. 33 No. 11, Oct. 19, 2015, pp. 1162-1165, XP055290196.

Wu, "Tn5 transposase-assisted transformation of indica rice", Plant J, 2011, pp. 186-200, vol. 68.

Xiang et al: "Temperature effect on CRISPR-Cas9 mediated genome editing", J Genetics Genomics, 2017, vol. 44, pp. 199-205.

Xie et al., RNA-Guided Genome Editing in Plants Using a CRISPR-Cas System, Nov. 2013, Molecular Plant, pp. 1975-1983, vol. 6, No. 6.

Xing e al., "A CRISPR/Cas9 toolkit for multiplex genome editing in plants", BMC Plant Biol, 2014, vol. 14 No. 1, pp. 327-338.

Xu et al: 'Efficient genome engineering in eukaryotes using Cas9 from *Streptococcus thermophilus*, Cellular and Molecular Life Sciences, vol. 72 No. 2, Jul. 20, 2014, pp. 383-399.

Xu et al: "Empower multiplex cell and tissue-specific CRISPR-mediated gene manipulation with self-cleaving ribozymes and tRNA", Nucleic Acids Res, 2016, vol. 45, No. 5 e28, 9 pp.

Xue et al: "CRISPR interference and priming varies with individual spacer sequences", Nucleic Acids Research, vol. 43 No. 22, Nov. 19, 2015, pp. 10831-10847.

Yan et al: "Functionally diverse type V CRISPR-Cas systems", Science, 2019, vol. 363, pp. 88-91.

Yao et al: "Homology-mediated end joining-based targeted integration using CRISPR/Cas9", Cell Research, 2017, vol. 27, pp. 801-814.

Yin et al: "CRISPR-Cas9 and CRISPR-Cpf1 mediated targeting of a stomatal developmental gene EPFL9 in rice", Plant Cell Rep, 2017, vol. 36, pp. 745-757.

Yin et al: "Partial DNA-guided Cas9 enables genome editing with reduced off-target activity", Nature Chem Biol, 2018, vol. 14, pp. 311-317 (and life sciences reporting summary).

Zetsche et al: "Cpf1 is a single RNA-guide endonuclease of a Class 2 CRISPR-Cas system", Cell, vol. 163 No. 3, Oct. 1, 2015, pp. 759-771, XP055267511.

Zhang, "Transcription Activator-Like Effector Nucleases Enable Efficient Plant Genome Engineering",Plant Physiology, 2013, vol. 161, pp. 20-27.

Zhang et al., "The CRISPR/Cas9 system produces specific and homozygous targeted gene editing in rice in one generation", Plant Biotech J, 2014, vol. 12 No. 6, pp. 797-807.

(56) References Cited

OTHER PUBLICATIONS

Zhang et al: "Efficient precise knockin with a double cut HDR donor after CRISPR/Cas9-mediated double-stranded DNA cleavage", Genome Biology, 2017, vol. 18 No. 35 18 pp.
Zhao et al: "An alternative strategy for targeted gene replacement in plants using a dual-sgRNA/Cas9 design", Nature Scientific Reports, 2016, vol. 6, p. 23890.
Ziemienowicz, Import of Agrobacterium T-DNA into plant nuclei: two distinct functions of VirD2 and VirE2 proteins, The Plant Cell, 2001, 13:369-383.
Zuris, et al: "Cationic lipid-mediated delivery of proteins enables efficient protein-based genome editing in vitro and in vivo", Nature Biotech, vol. 33 No. 1, Oct. 30, 2015, pp. 73-80.
Sanders: "Scientists find new and smaller CRISPR gene editor: Casx", Phys Org, Feb. 5, 2019.
Strecker et al: "Engineering of CRISPR-Cas12b for human genome editing", Nature Communications 2019, | https://doi.org/10.1038/s41467-018-08224-4.
Abdullah, R. et al. Efficient Plant Regeneration from Rice Protoplasts Through Somatic Embryogenesis. Nature Biotechnology, vol. 4, pp. 1087-1090, Jan. 12, 1986.
Bashir et al., Expression and enzyme activity of glutathione reductase is upregulated by Fe-deficiency in graminaceous plants. Plant Mol Biol 2007, vol. 65, pp. 277-284.
Cenik et al: "Argonaute proteins", Current Biology vol. 21 No. 12, R446-449, 2011.
Chang et al., Complete genome sequence of Acidaminococcus fermentans type strain (VR4T), Standards in Genomics Sciences 2010, vol. 3, pp. 1-14.
Christou et al., Stable transformation of soybean callus by DNA-coated gold particles. Plant Physiol 1988 vol. 87, pp. 671-674.
Chylinski, et al., (2014) "Classification and evolution of type II CRISPR-Cas systems" Nucleic Acids Res. 42 (10_:6091-6105.
Database "Uncharacterized protein from *Sulfurospirillum* sp. SCADC." Uniprot Access No. A0A087MA12 (2014).
Glenn et al: "Field guide to next-generation DNA sequencers", Mol Ecol Resources vol. 11 pp. 759-769, 2011.
Hidalgo-Cantabrana and Barrangou, "Characterization and applications of Type I CRISPR-Cas systems", Biochemical Society Transactions (2020) vol. 48 Issue 1 pp. 15-23.
Hinchee et al., Production of transgenic soybean plants using Agrobacterium-mediated DNA transfer. Biotechnology, 1988, vol. 6 pp. 915-922.
Hink et al., "Structural Dynamics of Green Fluorescent Protein Alone and Fused with a Single Chain Fv Protein", J Biological Chemistry vol. 275 No. 23 pp. 17556-17560 (2000).
Hsu, et al., (2014) "Development and Applications of CRISPR-Cas9 for Genome Engineering" Cell 157:1262-1278.
Kim et al., Chimeric crRNAs with 19 DNA residues in the guide region show the retained DNA cleavage activity of Cas9 with potential to improve the specificity. Chem. Commun., 2019, 55: 3552-3555.
Kindle, High-frequency nuclear transformation of Chlamydomonas reinhardtii. Proc Natl Acad Sci vol. 87 pp. 1228-1232. 1990.
Li et al., 2009, "Site Site-Specific Integration of Transgenes in Soybean via Recombinase-Mediated DNA Cassette Exchange", Plant Physiol 151:1087-1095.
Li, et al. Challenges in CRISPR/CAS9 Delivery: Potential Roles of Nonviral Vectors, Human Gene Therapyvol. 26, No. 1, 26(7):452-62 2015.
Majorek et al., 2014, The RNase H=like superfamily: new members, comparative structural analysis and evolutionary classification. Nucleic Acids Res vol. 42 Issue 7, pp. 4160-4179.
Nakade et al., "Cas9, Cpf1 and Cdc1/2.3—what's next?", Bioengineered vol. 8 No. 3 pp. 265-273 (2017).
Natsume et al: "Hybridization energies of double strands composed of DNA, RNA, PNA and LNA", Chemical Physical Letters vol. 434, pp. 133-138, 2007.
Nirenberg et al. "Historical review: Deciphering the genetic code—a personal account." Trends in Biotechnology, 29 (1): 46-54. 2003.
Niishimasu et al: "Crystal Structure of Cas9 in Complex with Guide RNA and Target DNA", Cell 2014, vol. 156, pp. 935-949.
Pickar-Oliver et al, Targeted transcriptional modulation with type I CRISPR-Cas systems in human cells; Nature Biotechnology (2019) vol. 37 pp. 1493-1501.
Schirle et al: "Structural basis for microRNA targeting", Science vol. 346 Issue 6209, pp. 608-613, 2014.
Schlake et al. Use of mutated FLP Recognition Target (FRT) sites for the exchange of expression cassettes at defined chromosomal loci. Biochem 33, pp. 12746-12751. 1994.
Shmakov et al: Discovery and functional characterization of Diverse Class 2 CRISPR-Cas systems. 2015. Molecular Cell vol. 60, pp. 385-397.
Sodeinde et al. Homologus recombination in the nuclear genome of Chlamydomonas reinhardtii. Proc natl Acad Sic 90, pp. 9199-9203. 1993.
Stryer pp. 108-109 of Stryer's Biochemistry (6th edition, 2002).
Van Overbeek et al: "DNA repair profiling reveals nonrandom outcomes at Cas9-mediated breaks", Mol Cell vol. 63 pp. 633-646, 2016.

\* cited by examiner

Cas-alpha 6 CRISPR-Cas System

Cas-alpha 5,7,8,9,10,11 CRISPR-Cas Systems

| SEQ ID | Description | Type | Organism |
|---|---|---|---|
| 1 | Cas1 encoded in Cas-alpha 1 locus | PRT | Candidatus Micrarchaeota archaeon |
| 5 | Cas2 encoded in Cas-alpha 1 locus | PRT | Candidatus Micrarchaeota archaeon |
| 9 | Cas4 encoded in Cas-alpha 1 locus | PRT | Candidatus Micrarchaeota archaeon |
| 13 | Cas-alpha 1 endonuclease gene | DNA | Candidatus Micrarchaeota archaeon |
| 17 | Cas-alpha 1 endonuclease | PRT | Candidatus Micrarchaeota archaeon |
| 21 | Cas-alpha 1 locus | DNA | Candidatus Micrarchaeota archaeon |
| 46 | Cas-alpha 1 repeat consensus | DNA | Candidatus Micrarchaeota archaeon |
| 57 | Cas-alpha 1 crRNA (N=any nt) | RNA | Candidatus Micrarchaeota archaeon |
| 60 | Cas-alpha 1 tracrRNA version 1 | RNA | Candidatus Micrarchaeota archaeon |
| 61 | Cas-alpha 1 tracrRNA version 2 | RNA | Candidatus Micrarchaeota archaeon |
| 62 | Cas-alpha 1 tracrRNA version 3 | RNA | Candidatus Micrarchaeota archaeon |
| 63 | Cas-alpha 1 tracrRNA version 4 | RNA | Candidatus Micrarchaeota archaeon |
| 69 | Cas-alpha 1 sgRNA version 1 | RNA | |
| 70 | Cas-alpha 1 sgRNA version 2 | RNA | |
| 71 | Cas-alpha 1 sgRNA version 3 | RNA | |
| 72 | Cas-alpha 1 sgRNA version 4 | RNA | |
| 79 | Complete Cas-alpha 1 locus engineered to target T2 | DNA | |
| 80 | Minimal Cas-alpha 1 locus engineered to target T2 | DNA | |

FIG. 7A

| SEQ ID | Description | Type | Organism |
|---|---|---|---|
| 2 | Cas1 encoded in Cas-alpha 2 locus | PRT | Candidatus Micrarchaeota archaeon |
| 6 | Cas2 encoded in Cas-alpha 2 locus | PRT | Candidatus Micrarchaeota archaeon |
| 10 | Cas4 encoded in Cas-alpha 2 locus | PRT | Candidatus Micrarchaeota archaeon |
| 14 | Cas-alpha 2 endonuclease gene | DNA | Candidatus Micrarchaeota archaeon |
| 18 | Cas-alpha 2 endonuclease | PRT | Candidatus Micrarchaeota archaeon |
| 22 | Cas-alpha 2 locus | DNA | Candidatus Micrarchaeota archaeon |
| 47 | Cas-alpha 1 repeat consensus | DNA | Candidatus Micrarchaeota archaeon |
| 58 | Cas-alpha 2 crRNA (N=any nt) | RNA | Candidatus Micrarchaeota archaeon |
| 64 | Cas-alpha 2 tracrRNA version 1 | RNA | Candidatus Micrarchaeota archaeon |
| 65 | Cas-alpha 2 tracrRNA version 2 | RNA | Candidatus Micrarchaeota archaeon |
| 66 | Cas-alpha 2 tracrRNA version 3 | RNA | Candidatus Micrarchaeota archaeon |
| 67 | Cas-alpha 2 tracrRNA version 4 | RNA | Candidatus Micrarchaeota archaeon |
| 73 | Cas-alpha 2 sgRNA version 1 | RNA | |
| 74 | Cas-alpha 2 sgRNA version 2 | RNA | |
| 75 | Cas-alpha 2 sgRNA version 3 | RNA | |
| 76 | Cas-alpha 2 sgRNA version 4 | RNA | |

FIG. 7B

| SEQ ID | Description | Type | Organism |
|---|---|---|---|
| 3 | Cas1 encoded in Cas-alpha 3 locus | PRT | Candidatus Aureabacteria bacterium |
| 7 | Cas2 encoded in Cas-alpha 3 locus | PRT | Candidatus Aureabacteria bacterium |
| 11 | Cas4 encoded in Cas-alpha 3 locus | PRT | Candidatus Aureabacteria bacterium |
| 15 | Cas-alpha 3 endonuclease gene | DNA | Candidatus Aureabacteria bacterium |
| 19 | Cas-alpha 3 endonuclease | PRT | Candidatus Aureabacteria bacterium |
| 23 | Cas-alpha 3 locus | DNA | Candidatus Aureabacteria bacterium |
| 48 | Cas-alpha 3 repeat consensus | DNA | Candidatus Aureabacteria bacterium |

FIG. 7C

| SEQ ID | Description | Type | Organism |
|---|---|---|---|
| 4 | Cas1 encoded in Cas-alpha 4 locus | PRT | Uncultured bacterium |
| 8 | Cas2 encoded in Cas-alpha 4 locus | PRT | Uncultured bacterium |
| 12 | Cas4 encoded in Cas-alpha 4 locus | PRT | Uncultured bacterium |
| 16 | Cas-alpha 4 endonuclease gene | DNA | Uncultured bacterium |
| 20 | Cas-alpha 4 endonuclease | PRT | Uncultured bacterium |
| 24 | Cas-alpha 4 locus | DNA | Uncultured bacterium |
| 49 | Cas-alpha 4 repeat consensus | DNA | Uncultured bacterium |
| 59 | Cas-alpha 4 crRNA (N=any nt) | RNA | Uncultured bacterium |
| 68 | Cas-alpha 4 tracrRNA version 1 | RNA | Uncultured bacterium |
| 77 | Cas-alpha 4 sgRNA version 1 | RNA | Uncultured bacterium |
| 102 | Cas-alpha 4 T2-1 sgRNA | RNA | |
| 103 | Cas-alpha 4 T2-1 sgRNA | RNA | |
| 104 | Cas-alpha 4 T2-1 crRNA | RNA | |
| 105 | Cas-alpha 4 T2-1 crRNA | RNA | |

*FIG. 7D*

| SEQ ID | Description | Type | Organism |
|---|---|---|---|
| 25 | Cas-alpha 5 endonuclease gene | DNA | Candidatus Micrarchaeota archaeon |
| 32 | Cas-alpha 5 endonuclease | PRT | Candidatus Micrarchaeota archaeon |
| 39 | Cas-alpha 5 locus | DNA | Candidatus Micrarchaeota archaeon |
| 50 | Cas-alpha 5 repeat consensus | DNA | Candidatus Micrarchaeota archaeon |

FIG. 7E

| SEQ ID | Description | Type | Organism |
|---|---|---|---|
| 26 | Cas-alpha 6 endonuclease gene | DNA | Uncultured bacterium |
| 33 | Cas-alpha 6 endonuclease | PRT | Uncultured bacterium |
| 40 | Cas-alpha 6 locus | DNA | Uncultured bacterium |
| 51 | Cas-alpha 6 repeat consensus | DNA | Uncultured bacterium |

FIG. 7F

| SEQ ID | Description | Type | Organism |
|---|---|---|---|
| 27 | Cas-alpha 7 endonuclease gene | DNA | Parageobacillus thermoglucosidasius |
| 34 | Cas-alpha 7 endonuclease | PRT | Parageobacillus thermoglucosidasius |
| 41 | Cas-alpha 7 locus | DNA | Parageobacillus thermoglucosidasius |
| 52 | Cas-alpha 7 repeat consensus | DNA | Parageobacillus thermoglucosidasius |

*FIG. 7G*

| SEQ ID | Description | Type | Organism |
|---|---|---|---|
| 28 | Cas-alpha 8 endonuclease gene | DNA | Acidibacillus sulfuroxidans |
| 35 | Cas-alpha 8 endonuclease | PRT | Acidibacillus sulfuroxidans |
| 42 | Cas-alpha 8 locus | DNA | Acidibacillus sulfuroxidans |
| 53 | Cas-alpha 8 repeat consensus | DNA | Acidibacillus sulfuroxidans |

*FIG. 7H*

| SEQ ID | Description | Type | Organism |
|---|---|---|---|
| 29 | Cas-alpha 9 endonuclease gene | DNA | Ruminococcus sp. |
| 36 | Cas-alpha 9 endonuclease | PRT | Ruminococcus sp. |
| 43 | Cas-alpha 9 locus | DNA | Ruminococcus sp. |
| 54 | Cas-alpha 9 repeat consensus | DNA | Ruminococcus sp. |

*FIG. 7I*

| SEQ ID | Description | Type | Organism |
|---|---|---|---|
| 30 | Cas-alpha 10 endonuclease gene | DNA | Syntrophomonas palmitatica |
| 37 | Cas-alpha 10 endonuclease | PRT | Syntrophomonas palmitatica |
| 44 | Cas-alpha 10 locus | DNA | Syntrophomonas palmitatica |
| 55 | Cas-alpha 10 repeat consensus | DNA | Syntrophomonas palmitatica |

FIG. 7J

| SEQ ID | Description | Type | Organism |
|---|---|---|---|
| 31 | Cas-alpha 11 endonuclease gene | DNA | Clostridium novyi |
| 38 | Cas-alpha 11 endonuclease | PRT | Clostridium novyi |
| 45 | Cas-alpha 11 locus | DNA | Clostridium novyi |
| 56 | Cas-alpha 11 repeat consensus | DNA | Clostridium novyi |

FIG. 7K

FIG. 8A

```
MNMSKTTISVKLKIIDLSSERKKEFLDNYFNEYAKATTFCQLRIRRLLLRNTHWLGKKEKSSKKWIF
CCCCCEEEEEEEEECCCCCHHHHHHHHHHHHHHHHHHHHHHHHHHHHHHHHCCCCCCHH

ESGICDICGENKELVNEDRNSGEPAKICKRCYNGRYGNQMIRKLFVSTKKREVQENMDIRRVAKL
CCCCCCCCCCCCCCCCCCCCCCCCCCCCCCCCCCHHEEEEECCCCCHHHHHHHHHHHHHHH

NNTHYHRIPEEAFDMI(KAADTAEKRRFKNVEYDKKRQMEFIEMFNDEKFRA)RPKKPNERETRYV
HHHCCCCCHHHHHHHHHHHHHHHHHHHHHHHHHHHHHHHHHHHHHHHHHHHCCCCHHHHHHH

HISKIESPSKG(YTLNGIKRKIDGMGKKIERAEKGLSRKK)FGYQGNRIKLDSNWVRFDLAESEIT
HHHHHCCHHHHHHHHHHHHHHHHHHHHHHHHHHHHHHHHCCCCCEEEEECCCCCCCEEEE

IPSLFKEMKLRITGPTNVHSKSGQIYFAEWFERINKQPNNYCYLIRKTSSNGKYEYYLQYTYEAE
EEECCCEEEEEEECCCCCCCCCCCCCCCHHHHHHHHHCCCCCEEEEEEEEEEEECCEEEEEEEE

VEANKEYAGCLGVDIGCSKLAAAVYYDSKNKKAQKPIEIFTNPIKKIKMRREKLIKILSRVKVRH
CCCCCCCEEEEEEECCCCCEEEEEEEEECCCCCCCCCCEEEEECHHHHHHHHHHHHHHCHH

RRRKIMQLSKTEPIIDYTCHKTARKIVEMANTAKAHTSMENLETGIKQKQQARETKKQKFYRNMF
HHHHHHHHHHHCCCEEHHHHHHHHHHHHHHHCCCCCCCCHHHHHHHHHHHHHHHHHHHHHH

LFRKLSKLIEYKALLKGIKIVYVKPDYTSQTCSSGADKEKTERPSQAIFRCLNPTCRYYQRDIN
HHHHHHHHHHHHHHCCEEEEEEEECCCCCCCCCCCCCCCCCCCCCHHHHHCCCCCCCCCCCCC

ADFNAAVNIAKKALNNTEVVTTLL (SEQ ID NO:17)
CHHHHHHHHHHHHHCCCCCCCEECC
```

MPSETYIYTKTLSLKLIPSDEEKQALENYFITFQRAVNFAIDRIVDIRSSFRYLNKNEQFPAVCDCCG
CCCEEEEEEEECCCCCHHHHHHHHHHHHHHHHHHHHHHHHHHHHHHHHCCCCCCCCCCCCC

KKEKIMYVNISNKTFKFKPSRNQKDRYTKDIYTIKPNAHICKTCYSGVAGNMFIRKQMYPNDKEGWK
CEEEEEEEECCCCCCCCCCCCCCCCCCCCCCHHHHHHHHHHHHHCCCEEEEECCCCCCCCCCE

— Zinc Finger — / — Coiled coil —

VSRSYNIKVNAPGLTGTEYAMAIRKAISILRSFEKRRNAERRIIEYEKSKKEYLELIDDVEKGKTN
EEEEEEEEECCCCCHHHHHHHHHHHHHHHHHHCHCCHHHHHHHHHHHHHHHHHHHHHHCCCCC

KIVVLEKEGHQRVKRYKHKNWPEKWQGISLNKAKSVKDIEKRIKKLKEWKHPTLNRPYVELHKNNV
CEEEECCCCHHHHHHHHHHCCCCCHHHHHHHHHHHHHHHHHHHHHHHHHCCCEEEEEECCCCC

RIVGYETVELKLGNKMYTIHFASISNLRKPERKQKKKSIEYLKHLLTLALKRNLETYPSIIKRGKNF
EEEEECEEEEECCCCCEEEECCCCCCCCCCCCHHHHHHHHHHHHHHHHHHHEECEEEEEECCEE

FLQYPVRVTVKVPKLTKNFKAFGIDRGVNRLAVGCIISKDGKLTNKNIFFFHGKEAWAKENRYKKIR
EEEEEEEEECCCCCCCCEECECCCCCCEEEEEEECCCCCHHHHHHHHHHHHHHHHHHHHHHHH

— BH — / — RuvCI —

DRLYAMAKKLRGDKTKKIRLYHEIRKKFRHKVKYFRRNYLHNISKQTVEIAKENTPTVIVLEDLRYL
HHHHHHHHHHCCCCHHHHHHHHHHHHHHHHHHHHHHHHHHHCCEEEEECCCCEEEEEECCHHHH

RERTYRGKGRSKKAKKTNYKLNTFTYRMLIDMIKYKAEEAGVPVMIIDPRNTSRKCSKCGYVDENNR
HHHHHHCCCCHHHHHHHHHHHHHHHHHHHHHHHHHHHHCCCEEEEEECCCCCCCCCCCCCCCCCC

— RuvCII — / — Zinc Finger —

KQASFKCLKCGYSLNADLNAAVNIAKAFYECPTFRWEEKLHAYVCSEPDK (SEQ ID NO:18)
CCCCEECCCCCCEEEHHHHHHHHHHHHHHCCCCCCHHHHHHHEECCCCC

*FIG. 8B*

MKSFKLKLLPTDEQNVLINEVECKWASLCTRMASKGHDKERLAPPDSSGNYF(NKTQLNQVNTDVI)
CCCEEECCCCHHHHHHHHHHHHHHHHHHHHCCCCCCCCCCCCCCCCCCHHHHHHHCCCCCHHH (DHMGALEESASQKERAVEKVKRRLKLISDMLS)PNLRDVSQQKPTTERPLEWKEGLLKTKYHTV
HHHHHHHHHHHHHHHHHHHHHHHHHHHHHHHHCCCCCCHHHCCCCCCCHHHHHHHHHHCCCCCH

HYWQKECDKLTKQKERMEKTIEKIKKGKITFKPTKMSLHQNCFSLSFGKGTFSMRPFSDTKRGIN
HHHHHHHHHHHHHHHHHHHHHHHHHHCCCCCEECCCEEEEECCEEEEECCCCCCEEEEECCCCC

LDMLTAPIQPAIGKNDGKSSLRSKEFIARNIENYIIFSIHSQLFGLSRSEELLNAKKELVAKR
HHHCCCCCCCCCCCCCCCHHHHHHHHHHHHHHEEEEEHHHHHHCCCCCHHHHHHHHHHHHHHH

DAMLKKKSDSLSKKIKELEKIVGRKITDSERSEIMSQGGKLSSEKFSEDNSYLKTLKVLAKDIIG
HHHHHHHHHHHHHHHHHHHHHHCCCHHHHHHCCCCCCCCCCCCCCCCEEEEEEEEECCCCCCCC

REELFRLKKYPIVIRKPLNERKKLRNLKPDEWEYYLQLSYDELEKKEFTPKTIMGIDRGLKHILA
CCCCEEECCCCEEEECCCCCCCEEEEEECCCHHHHHHHHHHHHHHHCCCCCCEEEECCCCEEEE

IAIYDPVQNKFVKNMLIPNPIL(GWKWKLRKIKRSIQHMERRIRAQQNAHVPENQLKRLKSIENK
EEEECCCCCCEEEEEECCCCCCHHHHHHHHHHHHHHHHHHHHHHHHCCCHHHHHHHHHHHHHHH

IDYYHNVSRQII)NLAHDFKSAIVVEDLQNMKQHGRKKSKGLRGLNYALSNFDYGKIMGLVKYKA
HHHHHHHHHHHHHHHHHHHHHHCCEEECCCHHHHHHHHHHHHHHCCCCHHHHHHHHHHHHHHH

ESENVPLLTVLPAGTSQNCAYCLLYGKEQGNYVRNNVNSKIGKCKLHGEI(DADINAARTIAICYH
HHCCCEEEEEECCCCCCCCCCCCCCCCCCCEEEEECCCCEEEEECCCCCHHHHHHHHHHHHHHH

KNINEPKPYGERKTFKRK (SEQ ID NO:19)
HCCCCCCCCHHHCCCCC

*FIG. 8C*

MAKNTITKTLKLRIVRPYNSAEVEKIVADEKNNREKLALEKNKDKVKEACSKHLKVAAYCTTQVE
CCCCCCEEEEEECCCCHHHHHHHHHHHHHHHHHHHHHHHHHHHHHHHHHHHHHHHHHHHCCHHH

RNACLFCKARKIDDKFYQKLRGQFPDAVEWQEISEIFRQLQKQAAEIYNQSLIELYYEIFIKGKG
HCCHHEECCCCHHHHHHHHHHCCCCCHHHHHHHHHHHHHHHHHHHHHHHHHHHHHHHHHHHCCC

IANASSVEHYLSDVCYTRAAELFKNAATASGLRSKIKSNFRLKELKNMKSGLPTTKSDNFPIPLV
CCCCHHHHHHHCCCHHHHHHHHHHHHHHHHHHHHHHHHHHHHHHHHCCCCCCCCCCCCCCCCEE

KQKGGQYTGFEISNHNSDFIKIPFGRWQVKKEIDKYRPWEKFDFEQVQKSPKPISLLLSTQRRK
EECCCCEEEEECCCCHHHHCCCEEEEEECCCHHHHCCCCCEEECCHHCCCCCCEEEECCCCCCC

RNKGWSKDEGTEAEIKKVMNGDYQTSYIEVKRGSKIGEKSAWMLNLSIDVPKIDKGVDPSIIGGI
CCCCCCCCCCCHHHEEECCCCCCCEEEEEEEEEECCCCCCEEEEEEEEEEECCCCCCCCCEEEE

DVGVKSPLVCAINNAFSRYSISDNDLFHFNKMFARRRILLKKNRHKRAGHGAKNKLKPITLTE
ECCCCCEEEEEEEEECCCCCCCHHHHHHHHHHHHHHHHHHHHHHHHCCCCCCCCCHHHHHHHH

KSERFRKKLIERWACELADFFIKNKVGTVQMENLESMKRKEDSYFNIRLRGFWPYAEMQNKIEFK
HHHHHHHHHHHHHHHHHHHHHHHHHHHCCCCCCHHHHCCCCCEEEEEEEECCCCCHHHHHHHH

LKQYGIEIRKVAPNNTSKTCSKCGHLNNYFNFEYRKKNKFPHFKCEKCNFKENADYNAALNISNP
HHHHCCEEEEEEEECCCCCCCCCCCCCCCCCCCCCHHCCCCCCCCCCCCCCCCCEEEHHHHHHHH

KLKSTKEEP (SEQ ID NO:20)
HHHCCCCCC

*FIG. 8D*

MISLKLKLLPDEEQKLLDEMFWKWASICTRVGFGRADKEDLKPPKDAEGVWESLTQLNQANTDI
CCCEEEEEECCHHHHHHHHHHHHHHHHHHHHCCCCCCCCCCCCCCCEEEHHHHHHCCCCCH

NDLREAMKHQKHRLEYEKNRLEAQRDDTQDALKNPDRREISTKRKDLFRPKASVEKGFLKLKYHQ
HHHHHHHHHHHHHHHHHHHHHHHHHHHHHHHHHCCCCHHHHHHHHHCCCCCCHHHHHHHHH

ERYWVRRLKEINKLIERKTKTLIKIEKGRIKFKFKATRITLHQGSEKIRFGDKPAFLIKALSGKNQI
HHHHHHHHHHHHHHHHHHHHHHHHHCCCEEEEEEEEEEECCCCCEEEEEEEEECCCHHHCCCCC

DAPFVVPEQPICGSVVNSKKYLDEITTNFLAYSVNAMLFGLSRSEEMLLKAKRPEKIKKKEEKL
CCCCCCCCCCCCCHHHHHHHHHHHHHHHHHHHHHHHHHHHHHHHCCCCCHHHHHHHHHHH

AKKQSAFENKKKELQKLLGRELTQQEEAIIEETRNQFFQDFEEVKITKQYSELLSKIANELKQKND
HHHHHHHHHCHHHHHHHHHHHHHHHHHHHHHHHHHHHHCCEEEECCCCCCCCCHHHHCC

FLKVNKYPILLRKPLKKAKSKKINNLSPSEWKYYLQFGVKPLLKQFSRRKSRNVLGIDRGLKHLL
EEEEECCCCCCCCCCCCCCCCCCCEEEEEEEEEEEEEECCCCCCCCCEEEEEEEEEECCCCEEE

AVTVLEPDKKTFVWNKLYPNPITGMKWRRRKLLRSLKRLKRRIKSQKHETIHENQTRKKLKSLQG
EEEEECCCCEEEEECCCCCCCCCCHHHHHHHHHHHHHHHHHHHHHHHHHHHHHHHHHHHHHCC

RIDDLLHNISRKIVETAKEYDAVIVVEDLQSMRQHGRSKGNRLKTLNYALSLFDYANVMQLIKYK
CHHHHHHHHHHHHHHHHHHCCEEEECCCCCCCCHHHHHHHHHHHHHHHHHHHHHHHCHHHH

AGIEGIQIYDVKPAGTSQNCAYCLLAQRDSHEYKRSQENSKIGVCLNPNCQNHKKQIDADLNAAR
HHHCCCEEEEECCCCCCCCCCCCHHHHHHHHHHHHCCCCCCCCEEEEECCCCCCEEECHHHHHH

VIASCYALKINDSQPFGTRKRFKKRTTN (SEQ ID NO:32)
HHHHHHHHCCCCCCCCCHHHHHCCCCC

*FIG. 8E*

MEVQKTVMKTLSLRIILRPLYSQEIEKEIKEEKERRKQAGGTGELDGGFYKKLEKKHSEMFSFDRL
CCHHHHHHHHHHHHHHCHHHHHHHHHHHHHHHHHHHHCCCCCCCCCHHHHHHHHHHHHCCHHHH

NLLLNQLQREIAKVYNHAISELYIATIAQGNKSNKHYISSIVYNRAYGYFYNAYIALGICSKVEA
HHHHHHHHHHHHHHHHHHHHHHHHHHHHHCCCCCCHHHHHHHHHHHHHHHHHHCCCHHHHHHHH

NFRSNELLTQQSALPTAKSDNFPIVLHKQKGAEGEDGGFRISTEGSDLIFEIPIPFYEYNGENRK
HHHCHHHHHHHHHHHCCCCCCCCCCCCCEEEECCCCCCCCCEEEEECCCCEEEEECCCCCCCCC

EPYKWVKKGGQKPVLKLILSTFRRQRNKGWAKDEGTDAEIRKVTEGKYQVSQIEINRGKKLGEHQ
CCEEEECCCCCCEEEEEEEEECCCCCCHHCCCCCCCHHHHHHHHHCCCCCEEEEEEEECCCCCC

KWFANFSIEQPIYERKPNRSIVGGLDVGIRSPLVCAINNSFSRYSVPSNDVFKFSKQVFAFRRRL
EEEEEEEECCCCCCCEEEEEEECCCCEEEEEEEEECCCCEEEEECCHHHHHHHHHHHHHHHHHH

LSKNSLKRKGHGAAHKLEPITEMTEKNDFRKKIIERWAKEVTNFFVKNQVGIVQIEDLSTMKDR
HHHHHHCCCCCCHHHHHCCCHHHHHHHHHHHHHHHHHHHHHHHHCCEEECCCCCCCHHHHHHHH

EDHFFNQYLRGFWPYYQMQTLIENKLKEYGIEVKRVQAKYTSQLCSNPNCRYWNNYFNFEYRKVN
CHHHHHHHHHHCCCCHHHHHHHHHHHHHHHHCCEEEECCCCCCCCCCCCCCCCCCCCCCCCCCC

KFPKFKCEKCNLEISADYNAARNLSTPDIEKFVAKATKGINLPEK (SEQ ID NO:33)
CCCEECCCCCCEEHHHHHHHHHHHHHHHHHHHHHHHCCCCCCCC

*FIG. 8F*

```
MKYTKVMRYQIIKPLNAEWDELGMVLRDIQKETRAALNKTIQLCWEYQGFSADYKQIHGQYPKPK
CCCCEEEECCCCCHHHHHHHHHHHHHHHHHHHHHHHCCCCCCHHHHHCCCCCCC

DVLGYTSMHGYAYDRLKNEFSKIASSNLSQTIKRAVDKWNSDLKEILRGDRSIPNFRKDCPIDIV
CCCCCCCCCHHHHHHHHHHHHCCHHHHHHHHHHHHHHHHHCCCCCCCCCCCEEEC

KQSTKIQKCNDGYVLSLGLINREYKNELGRKNGVFDVLIKANDKTQQTILERIINGDYTYTASQI
CCEEEEECCEEEEEEECCCCHHHHHHHHHHHHHCCEEEEEEECCHHHHHHHHCCEEEEEEEEEE

INHKNKWFINLTYQFETKETALDPNNVMGVDLGIVYPVYIAFNNSLHRYHIKGETERFRRQVEK
EEECCEEEEEEEEECCCCCCCCCCCEEEEEECCCCEEEEEECCCCCCCCCHHHHHHHHHH

RKRELLNQGKYCGDGRKGHGYATRTKSIESISDKIARFRDTCNHKYSRFIVDMALKHNCGIIQME
HHHHHHHHCCCCCCCCCCCCCCCHHHHHHHHHHCCHHHHHHHHHHHHHHHHHHHCCCCEEEEC

DLTGISKESTFLKNWTYDLQQKIEYKAREAGIQVIKIEPQYTSQRCSKCGYIDKENRQEQATFK
CCCCCHHHHHHHHHHCCHHHHHHHHHHHHHHHHHHHHCCEEEEECCCCCCCCCCCCCCCCEEE

CIECGFKITNADYNAARNIAIPNIDKIIRKTLKMQ (SEQ ID NO:34)
EEECCCEEEHHHHHHHHHHHHHHHHHHHHHHHCCC
```

*FIG. 8G*

```
MIKVYRYEIVKPLDLDWKEFGTILRQLQQETRFALNKATQLAWEWMGFSSDYKDNHGEYPKSDI
CEEEEEECCCCCCHHHHHHHHHHHHHHHHHHHHHHHHHHCCCCCCCCCCCCCCCCHHCC

LGYTNVHGYAYHTIKTKAYRLNSGNLSQTIKRATDREKAYQKEILRGDMSIPSYKRDIPLDLIKE
CCCCCCCHHHHHHHHHHHHHHHHHCCHHHHHHHHHHHHHCCCCCCCCCCCCCCCCCCCC

NISVNRMNHGDYIASLSLLSNPAKQEMNVKRKISVIIIVRGAGKTIMDRILSGEYQVSASQIIHD
EEEEECCCEEEEEEEEEECCCCCCCCCCCCCCCCEEEEEEECCCHHHHHHHCCCEEEEEEEEE

DRKNKWYLNISYDFEPQTRVLDLNKIMGIDLGVAVAVYMAFQHTPARYKLEGGETENFRRQVESR
CCCEEEEEEEEECCCCCCCCHHHHHHHCCCEEEEECCCEEEEEEECCCCCHHHHHHHHHHHH

RISMLRQGKYAGGARGGHGRDKRIKPIEQLRDKIANERDTTNHRYSRYIVDMAIKEGCGTIQMED
HHHHHHHHCCCCCCCCCCCCCHHHHHHHHHHHHHHHHHHHHHHHHHHHHCCCEEEEECC

LTNIRDIGSRFLQNWTYYDLQQKIIYKAEEAGIKVIKIDPQYTSQRCSECGNIDSGNRIGQAIFK
HHHHHHHHHHCCCCHHHHHHHHHHHHHHHHHHHHHHCCCEEEEECHHHCCCCCCCCCCCEEE

CRAGYEANADYNAARNIAIPNIDKIIAESIK (SEQ ID NO:35)
ECCCCEEEHHHHHHHHHHHHHHHHHHHCCC
```

*FIG. 8H*

MVKVKIHLISEQFDKAGNRIDYEEVNKIILWELQKQTREAKNKTVQLLWEWNNFSSDYVKASGIY
CEEEEEECCHHHHHHHHHHHHHHHHHHHHHHHHCCCCCHHHHHHHCCC

PKAKDIFGYSSVHGQANKELRTKLAINSSNLSTTTMDVCKNFNTYKKEVWKGKRSVPSYKSDQPL
CHHCCCCCHHHHHHHHHHHHHCCHHHHHHHHHHHHHHHHHHCCCCCCCCCCCCCC

DLHKDSIKLIYENNEFYVRLALLKKAEFAKYGFKDGFRFKMQVKDNSTKTILERCFDEVYKINAS
CCCEEEEEECCHHHHHHHHHHHHCCHHHCCCCCCCCCEEEEEEECCCHHHHHHHCCCEEEEEE

KLLYDQKKKKWKLNLSYSFDNKNISELDKEKILGVDVGVNCPLVASVFGDRDRFIIKGGEIEKFR
EEEEECCEEEEEEECCCCEEEECCCHHHHHHHHCCCCCCCCEEEEEECCCCCCCCEEEEECHHHHH

KSVEARRRSMLEQTKYCGDGRIGHGRKKRTEPAINIGDKIARFRDTTNHKYSRALIEYAVKKGCG
HHHHHHHHHHHHCCCCCCCCCCCCCCCCCCHHHHHHHHHHHHHHHHHHHHHHHCEEEEEECHHHHHH

TIQMEKLTGITSKSDRFLKDWTYDLQTKIENKAKEVGINVVYIAPKYTSQRCSKCGYIHKDNRP
EEEECCCCCHHHHHHHHHHCCHHHHHHHHHHHHCEEEECCCEEEEEEEECCCCCCCCCCCCCC

NQAKFRCLECDFESNADYNASQNIGIKNIDKIIEKDLQKQESEVQVNENK (SEQ ID NO:36)
CCCEECCCCEECHHHHHHHHHHHHHHHHHHHCCHHEEEEEECCCC

FIG. 8I

```
MGESVKAIKLKILDMFLDPECTKQDDNWRKDLSTMSRFCAEAGNMCLRDLYNYFSMPKEDRISSK
CHHHHHHHHHHHHCCCCCCCCCCCHHHHHHHHHHHHHHHHHHHHHHHHHHHHHCCCCCCCCHH

DLYNAMYHKTKLLHPELPGKVANQIVNHAKDVWKRNAKLIYRNQISMPTYKITTAPIRLQNNIYK
HHHHHHHHHHHHCCCCCHHHHHHHHHHHHHHHHHHHHHHHHCCCCCCCCCCCCCCCCCCCEEE

LIKNKNKYIIDVQLYSKEYSKDSGKGTHRYFLVAVRDSSTRMIFDRIMSKDHIDSSKSYTQQLQ
EEECCEEEEEEEECCEECCCCCCCCCEEEEEEEEEEECCCCEEEEEEECCHHHCCCCCEEEEE

IKKDHQGKWYCIIPYTEPTHETVLDPDKVMGVDLGVAKAVYWAFNSSYKRGCIDGGEFEHFRKMI
EEECCCCEEEEEEEECCCCCCCCCCCCCEEEEEECCCCCEEEEEEEEEEECCCCCCCCHHHHHH

RARRVSIQNQIKHSGDARKGHGRKRALKPIETLSEKEKNFRDTINHRYANRIVEAAIKQGCGTIQ
HHHHHHHHHHCCCCCCCCCCCCCHHHHHHHHHHHHHCHHHHHHHHHHHHHHHHHHHHHCCEEE

IENLEGIADTTGSKFLKNWPYYDLQTKIVNKAKEHGITVVAINPQYTSQRCSMCGYIEKTNRSSQ
EECCCHHCCCCCCCCCHHHHCCCHHHHHHHHHHHHHCCEEEEEECCHHCCCCCCCCCCCCCC

AVFECKQCGYGSRTICINCRHVQVSGDVCEECGGIVKKENVNADYNAAKNISTPYIDQIIMEKCL
CEECCCEEEEEECCCCCCCCEEEECCEECCCCHHHCHHHHHHHHHHHHHHHHHHHHHHHHHHHH

ELGIPYRSITCKECGHIQASGNTCEVCGSTNILKPKKIRKAK (SEQ ID NO:37)
HCCCCCCCCCCCCCCCCCCCCCCCCCCCEECCCCCCCCCCC
```

FIG. 8J

```
MITVRKIKLTTIMGDKDTRNSQYKWIRDEQYNQYRALNMGMFYLAVNDILYMNESGLEIRTIKDLK
CEEEEEEEECCCCCHHHHHHHHHHHHHHHHHHHHHHHHHHHHHHHHHHHCCCCCCHHHH

DCEKDIDKNKKEIEKLTARLEKEQNKKNSSSEKLDEIKYKISLVENKIEDYKLKIVELNKILEET
HHHHHHHHHHHHHHHHHHHHHHCCHHHHHHHHHHHHHHHHHHHHHHHHHHHHHHHHHHHHHH

QKERMDIQKEFKEKYVDDLYQVLDKIPFKHLDNKSLVTQRIKADIKSDKSNGLLKGERSIRNYKR
HHHHHHHHHHHHHHHHHHHHHHHHHHHHHHHHHHHHHHCCCCHHHHHHHHHHCCCCCCCCC

NFPLMTRGRDLKFKYDDNDDIEIKWMEGIKFKVILGNRIKNSLELRHTLHKVIEGKYKICDSSLQ
CCCCCCCCEEEEEEECCCCCCEEEEEEEECCCEEEEEEECCCCCHHHHHHHHHCCEEEEEEEE

FDKNNNLIINLTLDIPIDIVNKKVSGRVVGVDLGLKIPAYCALNDVEYIKKSIGRIDDFLKVRTQ
ECCCEEEEEEEECCCCCCCEEEEEECCCCCCCCEEEEEECCCCCEEEECHHHHHHHHH

MQSRRRLQIAIQSAKGGKGRVNKLQALERFAEKEKNFAKTYNHFLSSNIVKFAVSNQAEQINME
HHHHHHHHHHHHHHCCCCHHHHHHHHHHHHHHHHHHHHHHHHHHHHHHHHHCCCCEEEC

LLSLKETQNKSILRNWSYYQLQTMIEYKAQREGIKVKYIDPYHTSQTCSKCGNYEEGQRESQADF
CCCCHHHHHHHHHHHHCCHHHHHHHHHHHHHHHHCCEEEECCCCCCCCCCCCCCCCCCEE

ICKKCGYKVNADYNAARNIAMSNKYITKKEESKYYKIKESMV  (SEQ ID NO:38)
EECCCCCEEEHHHHHHHHHHHHHHHHHCHHCCCCHHHHHHHCC
```

FIG. 8K

Example human cell culture Cas-alpha DNA expression construct

Example Zea mays Cas-alpha DNA expression construct

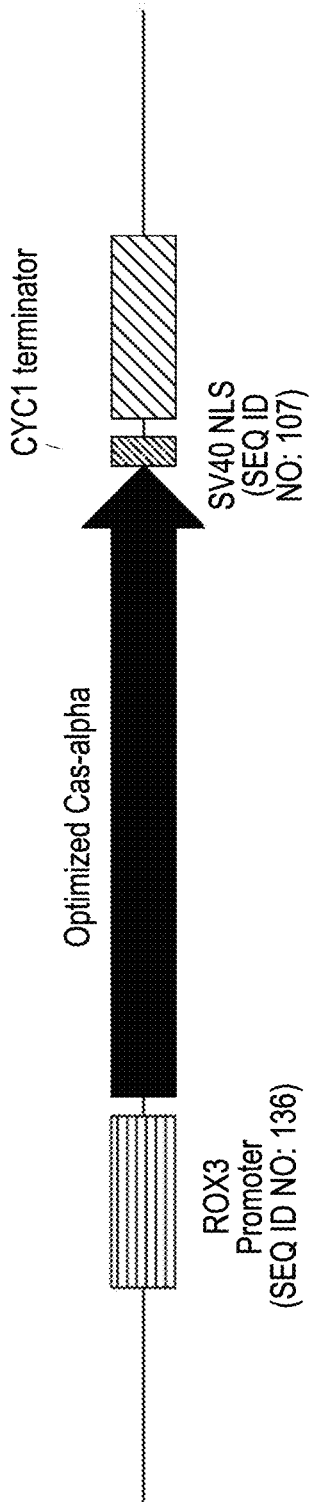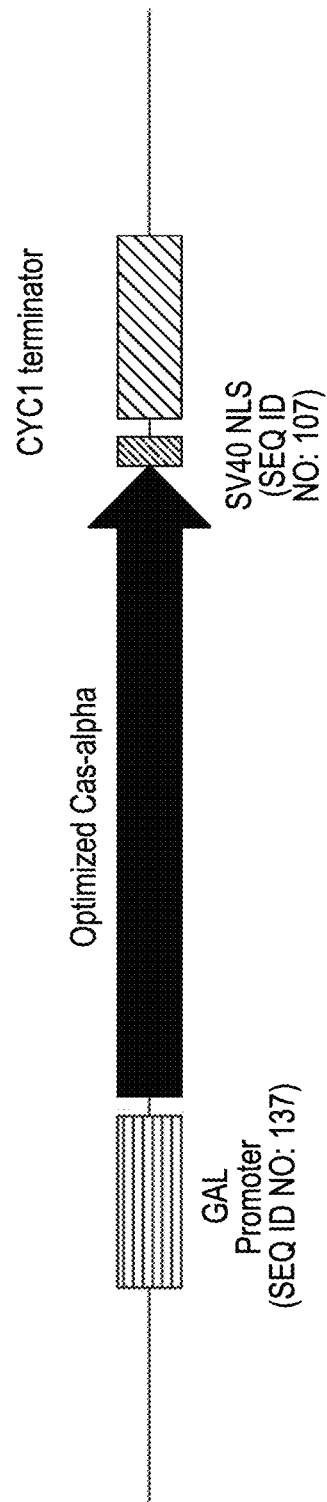
FIG. 10C
FIG. 10D

Example human cell culture single guide RNA (sgRNA) DNA expression construct (polymerase III)

Example Zea mays single guide RNA (sgRNA) DNA expression construct (polymerase III)

Example Saccharomyces cerevisiae single guide RNA (sgRNA) DNA expression construct (polymerase III)

Example Zea mays single guide RNA (sgRNA) DNA expression construct (polymerase II)

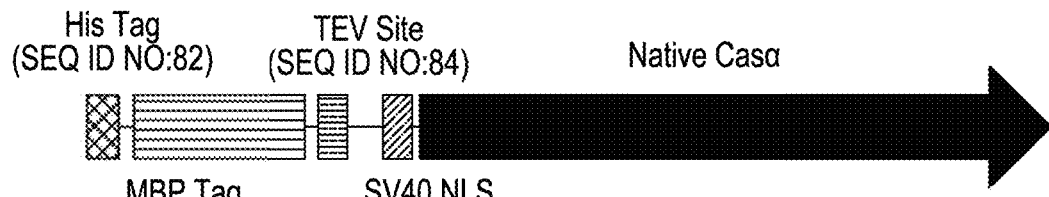
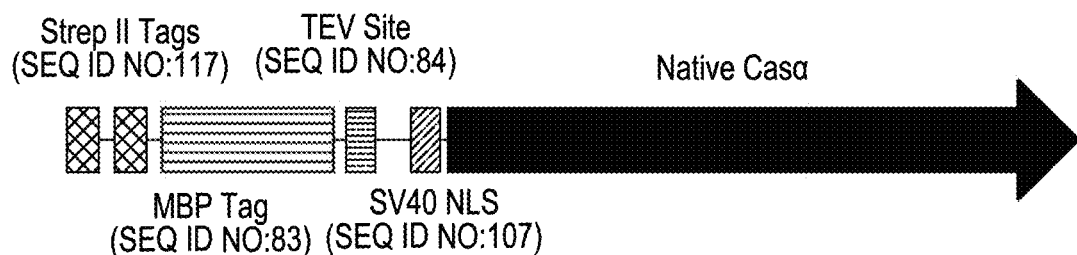
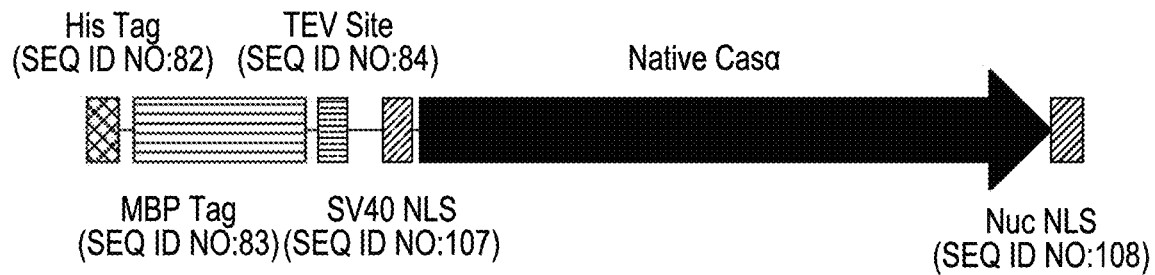
Example genes engineered for recombinant expression and purification of Cas-alpha protein in E. coli
*FIG. 12*

FIG. 14A

FIG. 14B

|  |  | PAM | sgRNA Target | Cleavage Site |
|---|---|---|---|---|
| SEQ ID NO: |  |  |  |  |
| 144 | Reference | CCACGACGGGGCGTTCCTTGCGCAGCTGTGCTCGACGTT | GTCACTGAAGCGGGAAGG |
| 145 | Mutation 1 | CCACGACGGGGCGTTCCTTGCGCAGCTGTGC--------- | ------ACTGAAGCGGGAAGG |
| 146 | Mutation 2 | CCACGACGGGGCGTTCCTTGCGCAGCTGTGTC-------- | -----ACTGAAGCGGGAAGG |
| 147 | Mutation 3 | CCACGACGGGGCGTTCCTTGCGCAGCTGTGTG-------- | -----gCTGAAGCGGGAAGG |
| 148 | Mutation 4 | CCACGACGGGGCGTTCCTTGCGCAGCTGTGCTC------- | -----ACTGAAGCGGGAAGG |
| 149 | Mutation 5 | CCACGACGGGGCGTTCCTTGCGCAGCTGTG---------- | -----ACTGAAGCGGGAAGG |
| 150 | Mutation 6 | CCACGACGGGGCGTTCCTTGCGCAGCTGTGCTCGA----- | --TGTCACTGAAGCGGGAAGG |
| 151 | Mutation 7 | CCACGACGGGGCGTTCCTTGCGCAGCTGTCACTGA----- | --------AGCGGGAAGG |
| 152 | Mutation 8 | CCACGACGGGGCGTTCCTTGCGCAGCTC------------ | ----ACTGAAGCGGGAAGG |
| 153 | Mutation 9 | CCACGACGGGGCGTTCCTTGCGCAGC-------------- | ----ACTGAAGCGGGAAGG |
| 154 | Mutation 10 | CCACGACGGGGCGTTCCTTGCGCAGCTGTGCT-------- | ---GTCACTGAAGCGGGAAGG |
| 155 | Mutation 11 | CCACGACGGGGCGTTCCTTGCGCAGCTGTG---------- | ---GTCACTGAAGCGGGAAGG |
| 156 | Mutation 12 | CCACGACGGGGCGTTCCTTGCGCAGCTG------------ | ---CACTGAAGCGGGAAGG |
| 157 | Mutation 13 | CCACGACGGGGCGTTCCTTGCGCAGCTGTGCTCGAC---- | -----TGAAGCGGGAAGG |
| 158 | Mutation 14 | CCACGACGGGGCGTTCCTTGCGCAGCTGTGC--------- | ----------GGGAAGG |
| 159 | Mutation 15 | CCACGACGGGGCGTTCCTTGCGCAGCTGTGCT-------- | --TCACTGAAGCGGGAAGG |
| 160 | Mutation 16 | CCACGACGGGGCGTTCCTTGCGCAGCTGTG---------- | --aCACTGAAGCGGGAAGG |
| 161 | Mutation 17 | CCACGACGGGGCGTTCCTTGCGCAGCTGTGC--------- | --CACTGAAGCGGGAAGG |
| 162 | Mutation 18 | CCACGACGGGGCGTTCCTTGCGCAGCTGTGC--------- | --CTGAAGCGGGAAGG |
| 163 | Mutation 19 | CCACGACGGGGCGTTCCTTGCGCAGCTG------------ | ------AGCGGGAAGG |

FIG. 18A

FIG. 18B

| SEQ ID NO: | | PAM sgRNA Target | Cleavage Site |
|---|---|---|---|
| 164 | Reference | TCCGCAACGGTGCGTCGCCGTTCAAGTTCACGGCGTTCAGGCGGCCGAGGATCTGCCTGGGCAAGGACTGGGGTACCTGCAGA |
| 165 | Mutation 1 | TCCGCAACGGTGCGTCGCCGTTCAAGTTCACGGCGTTC---------CCGAGGATCTGCCTGGGCAAGGACTGGGGTACCTGCAGA |
| 166 | Mutation 2 | TCCGCAACGGTGCGTCGCCGTTCAAGTTCACGGCGTTC--------GGCCGAGGATCTGCCTGGGCAAGGACTGGGGTACCTGCAGA |
| 167 | Mutation 3 | TCCGCAACGGTGCGTCGCCGTTCAAGTTCACGGCGTTCCA-------GCCGAGGATCTGCCTGGGCAAGGACTGGGGTACCTGCAGA |
| 168 | Mutation 4 | TCCGCAACGGTGCGTCGCCGTTCAAGTTCACGGCGTTC--------GCCGAGGATCTGCCTGGGCAAGGACTGGGGTACCTGCAGA |
| 169 | Mutation 5 | TCCGCAACGGTGCGTCGCCGTTCAAGTTCACGGCGTTC-------gGCCGAGGATCTGCCTGGGCAAGGACTGGGGTACCTGCAGA |

1. Colony with functional ade2 gene (white)
2. Colony with non-functional ade2 gene (red)
3. Colony with a sector containing a non-functional ade2 gene (white with red stripe)

FIG. 19C

CRISPR-CAS SYSTEMS FOR GENOME EDITING

CROSS-REFERENCE TO RELATED APPLICATIONS

This application claims the benefit of U.S. Provisional Application No. 62/779,989 filed 14 Dec. 2018, U.S. Provisional Application No. 62/794,427 filed 18 Jan. 2019, U.S. Provisional Application No. 62/819,409 filed 15 Mar. 2019, U.S. Provisional Application No. 62/852,788 filed 24 May 2019, and 62/913,492 filed 10 Oct. 2019, all of which are herein incorporated by reference in their entireties.

REFERENCE TO SEQUENCE LISTING SUBMITTED ELECTRONICALLY

The official copy of the sequence listing is submitted electronically via EFS-Web as an ASCII formatted sequence listing with a file named RTS21920B_SequenceListing_ST25.txt created on 9 Dec. 2019 and having a size of 714,386 bytes and is filed concurrently with the specification. The sequence listing comprised in this ASCII formatted document is part of the specification and is herein incorporated by reference in its entirety.

FIELD

The disclosure relates to the field of molecular biology, in particular to compositions of novel RNA-guided Cas endonuclease systems, and compositions and methods for editing or modifying the genome of a cell.

BACKGROUND

Recombinant DNA technology has made it possible to insert DNA sequences at targeted genomic locations and/or modify specific endogenous chromosomal sequences. Site-specific integration techniques, which employ site-specific recombination systems, as well as other types of recombination technologies, have been used to generate targeted insertions of genes of interest in a variety of organism. Genome-editing techniques such as designer zinc finger nucleases (ZFNs), transcription activator-like effector nucleases (TALENs), or homing meganucleases, are available for producing targeted genome perturbations, but these systems tend to have low specificity and employ designed nucleases that need to be redesigned for each target site, which renders them costly and time-consuming to prepare.

Newer technologies utilizing archaeal or bacterial adaptive immunity systems have been identified, called CRISPR (Clustered Regularly Interspaced Short Palindromic Repeats), which comprise different domains of effector proteins that encompass a variety of activities (DNA recognition, binding, and optionally cleavage).

Despite the identification and characterization of some of these systems, there remains a need for identifying novel effectors and systems, as well as demonstrating activity in eukaryotes, particularly animals and plants, to effect editing of endogenous and previously-introduced heterologous polynucleotides.

Herein is described a novel Cas endonuclease, "Cas-alpha", exemplary proteins, and methods and compositions for use thereof.

SUMMARY

Disclosed herein are compositions of novel Cas endonucleases and methods of use thereof. These endonucleases, of the novel class Cas-alpha, are capable of being guided by a guide polynucleotide to target and cleave double-stranded DNA in a PAM-dependent fashion, as demonstrated in prokaryotes (*E. coli*) and three different kingdoms of eukaryotes: plant, animal, and fungi. The In one aspect, a synthetic composition is provided, comprising a CRISPR-Cas endonuclease comprising at least one zinc-finger-like domain, at least one bridge-helix-like domain, a tri-split RuvC domain (comprising non-contiguous RuvC-I domain, RuvC-II domain, and RuvC-III domain), optionally comprising a heterologous polynucleotide.

In any aspect, in any of the compositions or methods, at least one component that has been optimized for expression in a eukaryotic cell, particularly a plant cell, a fungal cell, or an animal cell, is provided.

In one aspect, a synthetic composition is provided, comprising a polynucleotide encoding CRISPR-Cas effector protein derived from an organism selected from the group consisting of: *Acidibacillus sulfuroxidans*, *Alicyclobacillus acidoterrestris*, *Aneurinibacillus danicus*, Archaea, *Bacillus*, *Bacillus cereus*, *Bacillus megaterium*, *Bacillus pseudomycoides*, *Bacillus* sp., *Bacillus thuringiensis*, *Bacillus toyonensis*, *Bacillus wiedmannii*, *Bacteroides plebeius*, *Bos taurus*, *Brevibacillus centrosporus*, *Candidatus Aureabacteria bacterium*, *Candidatus Levybacteria bacterium*, *Candidatus Micrarchaeota archaeon*, *Cellulosilyticum ruminicola*, *Clostridioides difficile*, *Clostridium botulinum*, *Clostridium fallax*, *Clostridium hiranonis*, *Clostridium ihumii*, *Clostridium novyi*, *Clostridium paraputrificum*, *Clostridium pasteurianum*, *Clostridium perfringens*, *Clostridium* sp., *Clostridium tetani*, *Clostridium ventriculi*, *Desulfovibrio fructosivorans*, *Dorea longicatena*, *Eubacterium siraeum*, *Flavobacterium thermophilum*, *Gallus gallus*, *Hepatitis delta* virus, *Homo sapiens*, *Human betaherpesvirus 5*, *Hydrogenivirga* sp., *Mus musculus*, *Parageobacillus thermoglucosidasius*, *Peptoclostridium* sp., *Phascolarctobacterium* sp., *Prevotella copri*, *Ruminiclostridium hungatei*, *Ruminococcus albus*, *Ruminococcus* sp., *Saccharomyces cerevisiae*, Simian virus 40, *Solanum tuberosum*, *Sulfurihydrogenibium azorense*, *Syntrophomonas palmitatica*, Tobacco etch virus, and *Zea mays*; and a heterologous polynucleotide.

In one aspect, a synthetic composition is provided, comprising: a eukaryotic cell, a heterologous CRISPR-Cas effector; wherein said heterologous CRISPR-Cas effector protein comprises fewer than 800, between 790 and 800, fewer than 790, between 780 and 790, fewer than 780, between 780 and 770, fewer than 770, between 770 and 760, fewer than 760, between 760 and 750, fewer than 750, between 750 and 740, fewer than 740, between 740 and 730, fewer than 730, between 730 and 720, fewer than 720, between 720 and 710, fewer than 710, between 710 and 700, or even fewer than 700 amino acids, such as fewer than 700, fewer than 790, fewer than 780, fewer than 750, fewer than 700, fewer than 650, fewer than 600, fewer than 550, fewer than 500, fewer than 450, fewer than 400, fewer than 350, or even fewer than 350 amino acids.

In one aspect, a synthetic composition is provided that comprises a CRISPR-Cas endonuclease, wherein said CRISPR-Cas endonuclease comprises, when aligned to SEQ ID NO:17, relative to the amino acid position numbers of SEQ ID NO:17, at least one, at least two, at least three, at least four, at least five, at least six, or seven of the following: a Glycine (G) at position 337, a Glycine (G) at position 341, a Glutamic Acid (E) at position 430, a Leucine (L) at position 432, a Cysteine (C) at position 487, a Cysteine (C)

at position 490, a Cysteine (C) at position 507, and/or a Cysteine (C) or Histidine (H) at position 512.

In one aspect, a synthetic composition is provided that comprises a CRISPR-Cas endonuclease, wherein said CRISPR-Cas endonuclease comprises one, two, or three of the following motifs: GxxxG, ExL, and/or one or more $Cx_n(C,H)$ (where n=one or more amino acids).

In one aspect, a synthetic composition is provided that comprises a CRISPR-Cas endonuclease, wherein said CRISPR-Cas endonuclease comprises one or more zinc finger motifs.

In one aspect, a synthetic composition is provided comprising a CRISPR-Cas effector protein sharing at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 250, between 250 and 300, at least 300, between 300 and 350, at least 350, between 350 and 400, at least 400, or greater than 400 contiguous amino acids of a sequence selected from the group consisting of SEQ ID NOs:17, 18, 19, 20, 32, 33, 34, 35, 36, 37, 38, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, and 371.

In one aspect, a synthetic composition is provided comprising a polynucleotide encoding a CRISPR-Cas effector protein sharing at least 50%, between 50% and 55%, at least 55%, between 55% and 60%, at least 60%, between 60% and 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 250, between 250 and 500, at least 500, between 500 and 600, at least 600, between 600 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or greater than 1000 amino acids of a polypeptide selected from the group consisting of SEQ ID NOs:17, 18, 19, 20, 32, 33, 34, 35, 36, 37, 38, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, and 371.

In one aspect, a synthetic composition is provided comprising a polynucleotide encoding a CRISPR-Cas effector protein that is capable of hybridizing with a polynucleotide sharing at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 1, 2, 3, 4, 5, 6, 7, 8, 9, 10, 11, 12, 13, 14, 15, 16, 17, 18, 19, 20, 21, 22, 23, 24, 25, 26, 27 28, 29, 30, or greater than 30 contiguous nucleotides of an RNA sequence selected from the group consisting of SEQ ID NOs:57, 58, 59, 64, 65, 66, 67, 68, 73, 74, 75, 76, 77, 102, 103, 104, 105, 177, 178, 179, 180, 181, 182, 185, 186, 187, 188, 189, 190, 191, 192, 193, 194, 195, 196, 197, 198, 204, 205, 206, 207, 208, 209, 210, 211, 212, 213, 214, 215, 216, 217, 218, 219, 220, 221, 222, 223, 224, 230, 231, 232, 233, 234, 238, 240, 241, 245, 246, 247, 248, 252, and 253.

Any of the methods or compositions herein may further comprise a heterologous polynucleotide. The heterologous polynucleotide may be selected from the group consisting of: a noncoding regulatory expression element such as a promoter, intron, enhancer, or terminator; a donor polynucleotide; a polynucleotide modification template, optionally comprising at least one nucleotide modification as compared to the sequence of a polynucleotide in a cell; a transgene; a guide RNA; a guide DNA; a guide RNA-DNA hybrid; an endonuclease; a nuclear localization signal; and a cell transit peptide.

In one aspect, methods are provided for using any of the compositions disclosed herein. In some embodiments, methods are provided for a Cas-alpha endonuclease to bind to a target sequence of a polynucleotide, for example in the genome of a cell or in vitro. In some embodiments, the Cas-alpha endonuclease forms a complex with a guide polynucleotide, for example a guide RNA. In some embodiments, the complex recognizes, binds to, and optionally creates a nick (one strand) or a break (two strands) in the polynucleotide at or near the target sequence. In some embodiments, the nick or break is repaired via Non-Homologous End Joining (NHEJ). In some embodiments, the nick or break is repaired via Homology-Directed Repair (HDR) or via Homologous Recombination (HR), with a polynucleotide modification template or a donor DNA molecule.

The novel Cas endonucleases described herein are capable of creating a double-strand break in, or adjacent to, a target polynucleotide that comprises an appropriate PAM, and to which it is directed by a guide polynucleotide, in any prokaryotic or eukaryotic cell. In some cases, the cell is a plant cell or an animal cell or a fungal cell. In some cases, a plant cell is selected from the group consisting of: maize, soybean, cotton, wheat, canola, oilseed rape, sorghum, rice, rye, barley, millet, oats, sugarcane, turfgrass, switchgrass, alfalfa, sunflower, tobacco, peanut, potato, tobacco, *Arabidopsis*, safflower, and tomato.

BRIEF DESCRIPTION OF THE DRAWINGS AND THE SEQUENCE LISTING

The disclosure can be more fully understood from the following detailed description and the accompanying drawings and Sequence Listing, which form a part of this application.

Figure 1B:
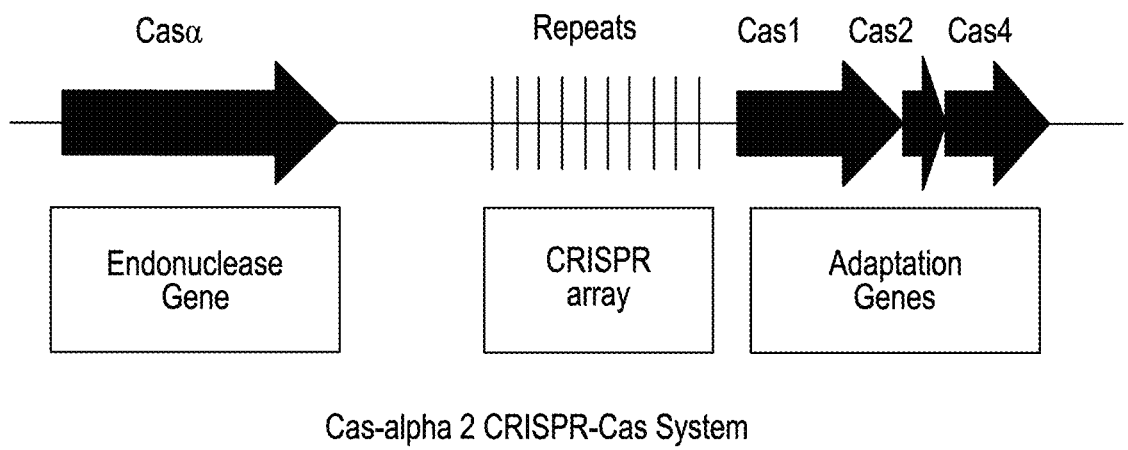
Figure 1C:
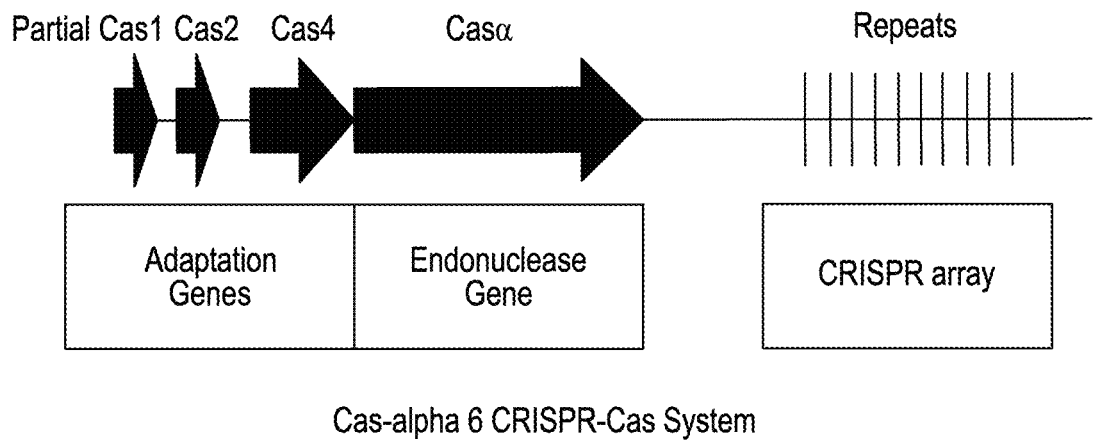
Figure 1D:
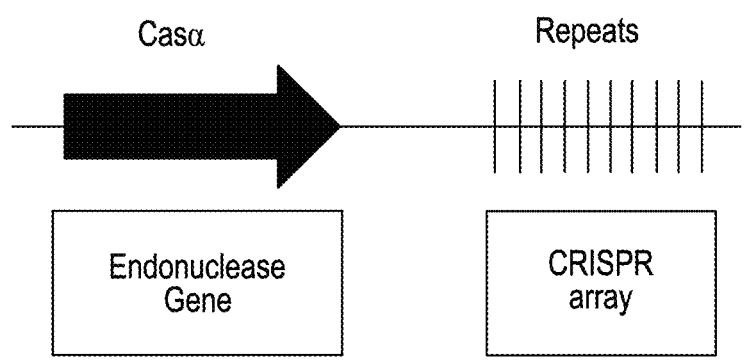

FIGS. 1A-1D depict the intact CRISPR-Cas system comprising all of the components required for acquisition and interference. These included genes that together encoded all the proteins needed for acquiring and integrated spacers (Cas1 and Cas2) and a novel protein comprising a DNA cleavage domain, Cas-alpha (α), in an operon-like structure adjacent to a CRISPR array. Additionally, a gene encoding a protein with homology to Cas4 was also encoded in the locus. FIG. 1A depicts the locus architecture for the Cas-alpha 1, Cas-alpha 3, and Cas-alpha 4 systems. FIG. 1B depicts the locus architecture for the Cas-alpha2 system. FIG. 1C depicts the locus architecture for the Cas-alpha 6 system. FIG. 1D depicts the locus architecture for the Cas-alpha 5, 7, 8, 9, 10, and 11 systems.

Figure 2:
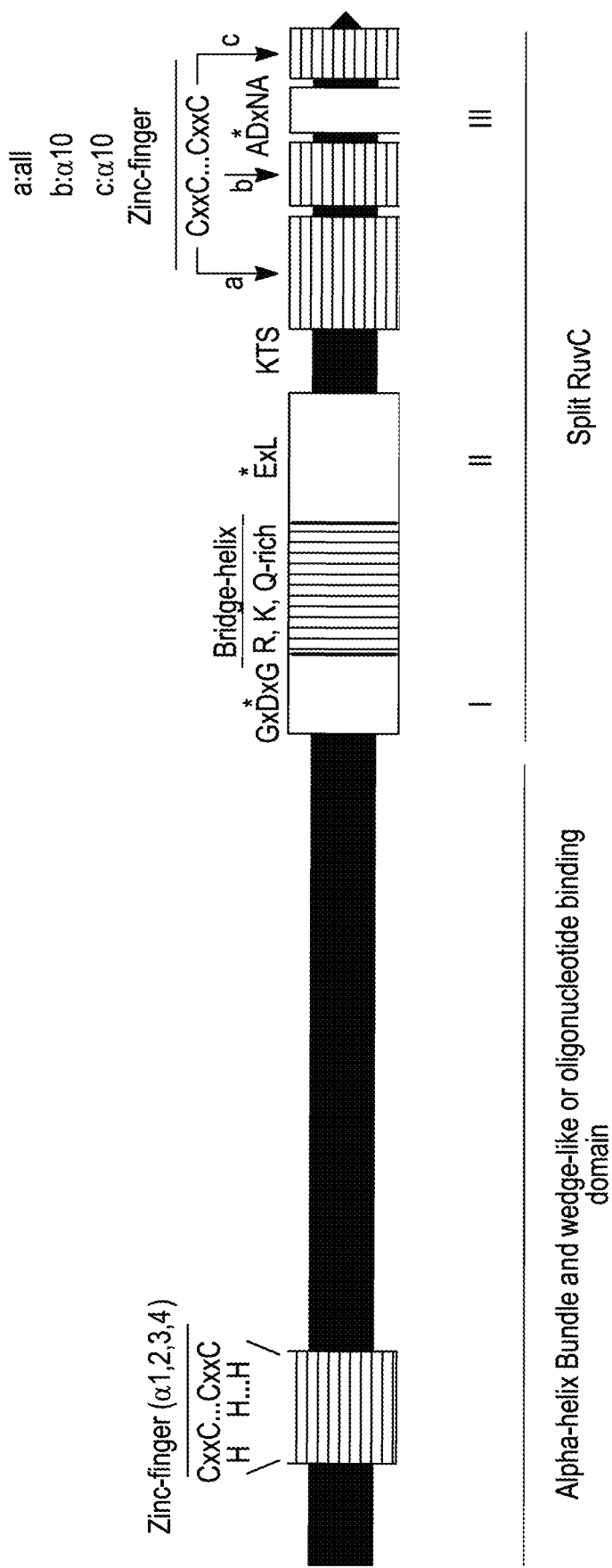

FIG. 2 shows a detailed structural examination of the Cas-alpha protein, depicting distinct differences from previously described Class 2 endonucleases. Conserved residues are indicated. Key residues involved in DNA cleavage are indicated with an asterisk. Numbers correspond to the Cas-alpha 1 protein.

Figure 3:
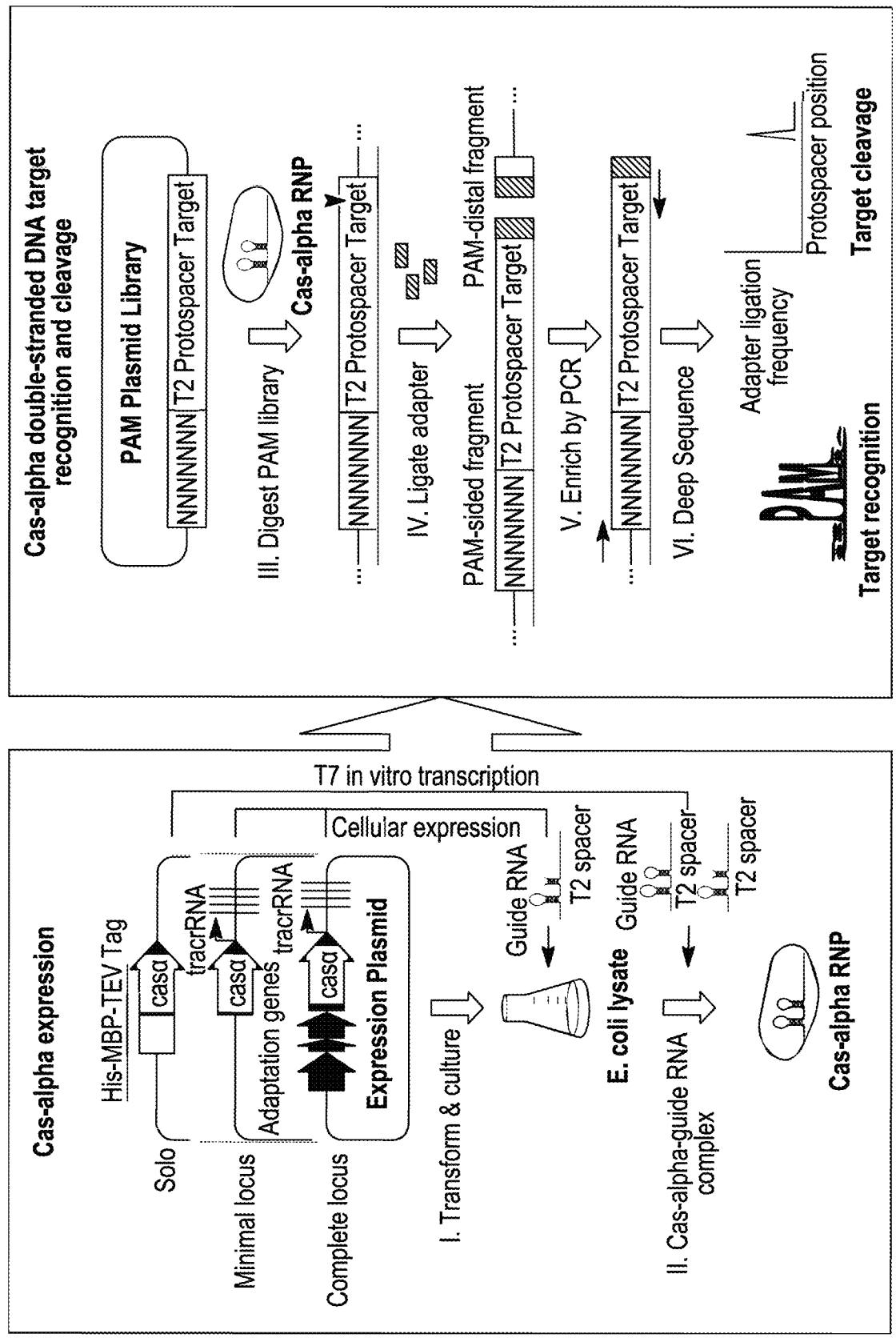

FIG. 3 outlines a method of detection of double stranded DNA target recognition and cleavage, using cell lysates expressing a Cas-alpha endonuclease.

Figure 4A:
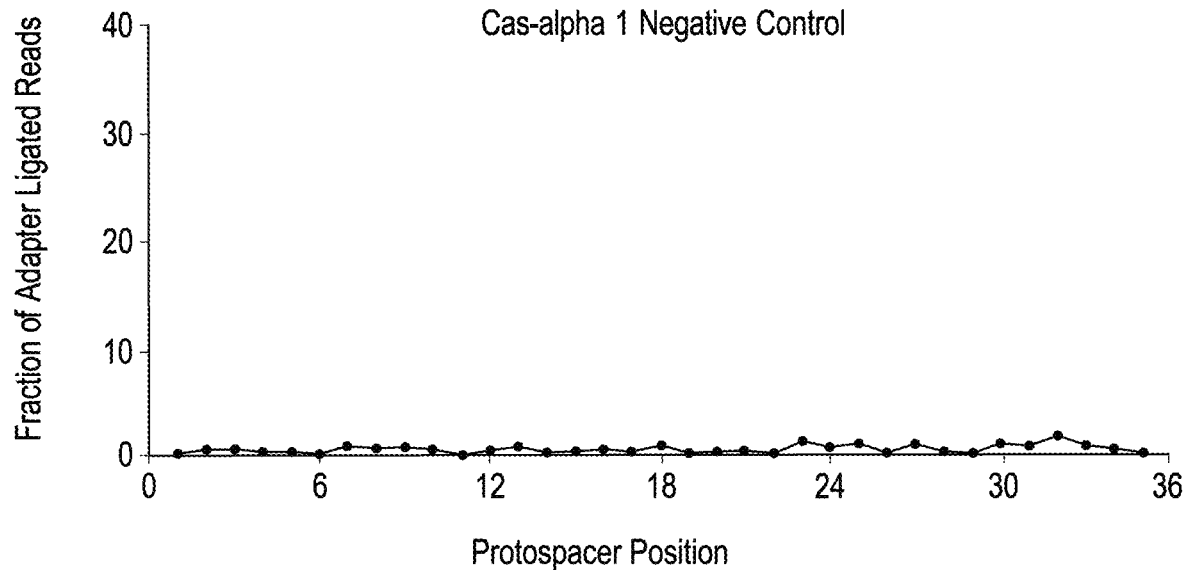
Figure 4B:
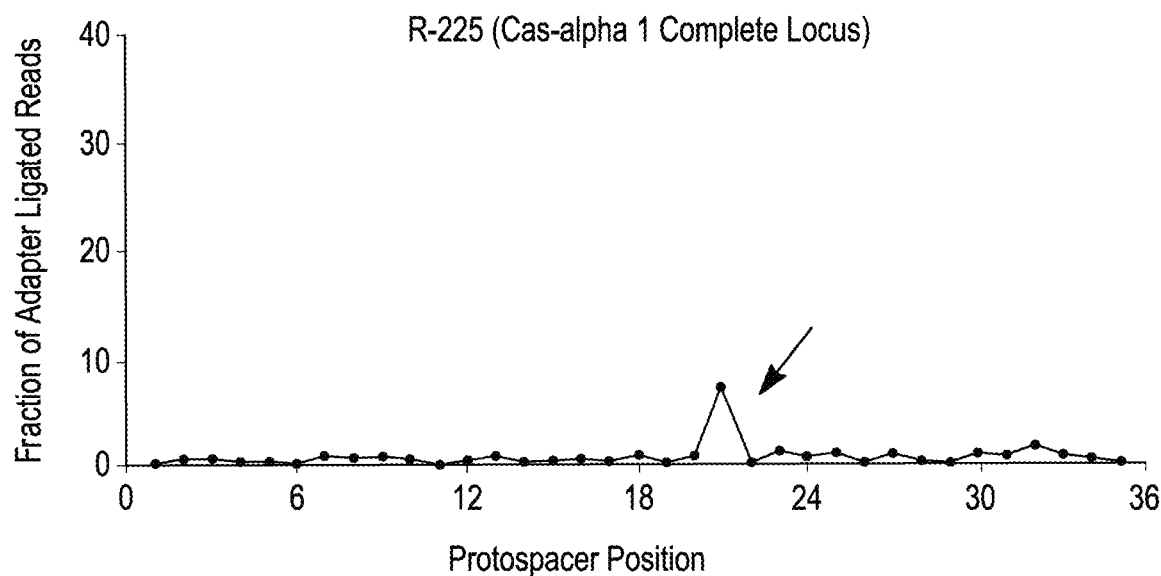
Figure 4C:
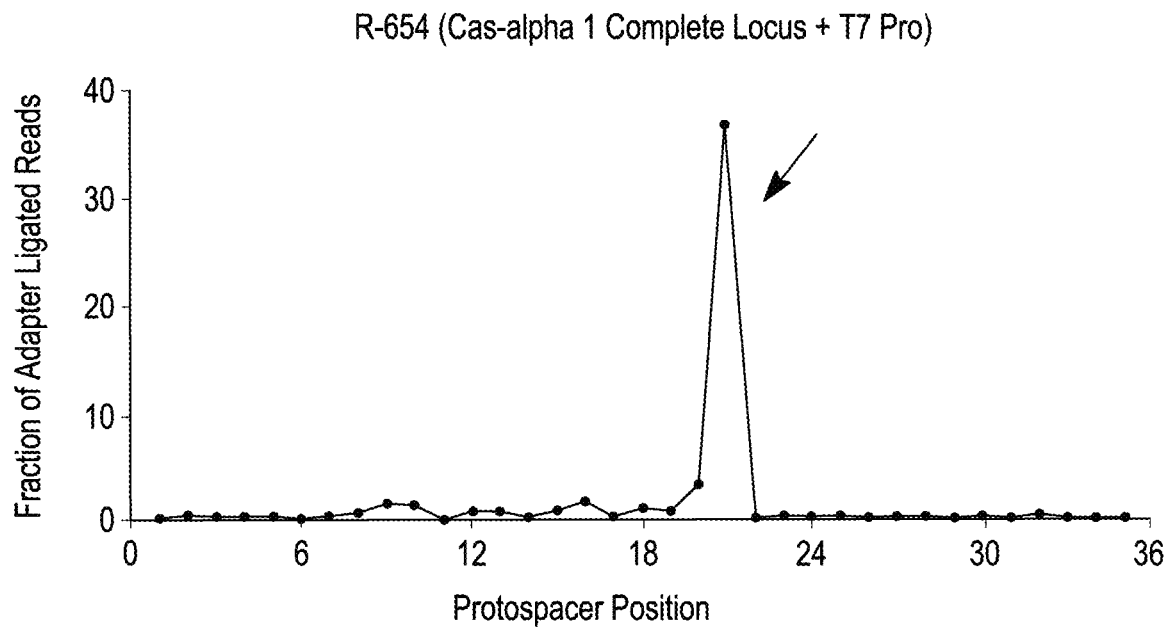
Figure 4D:
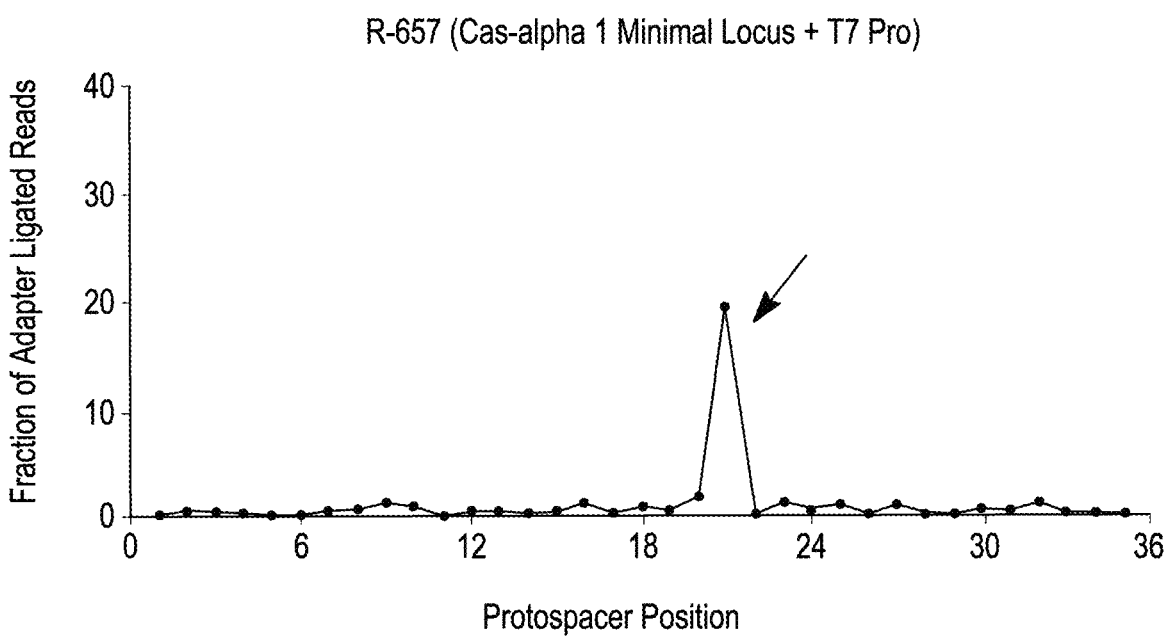
Figure 4E:
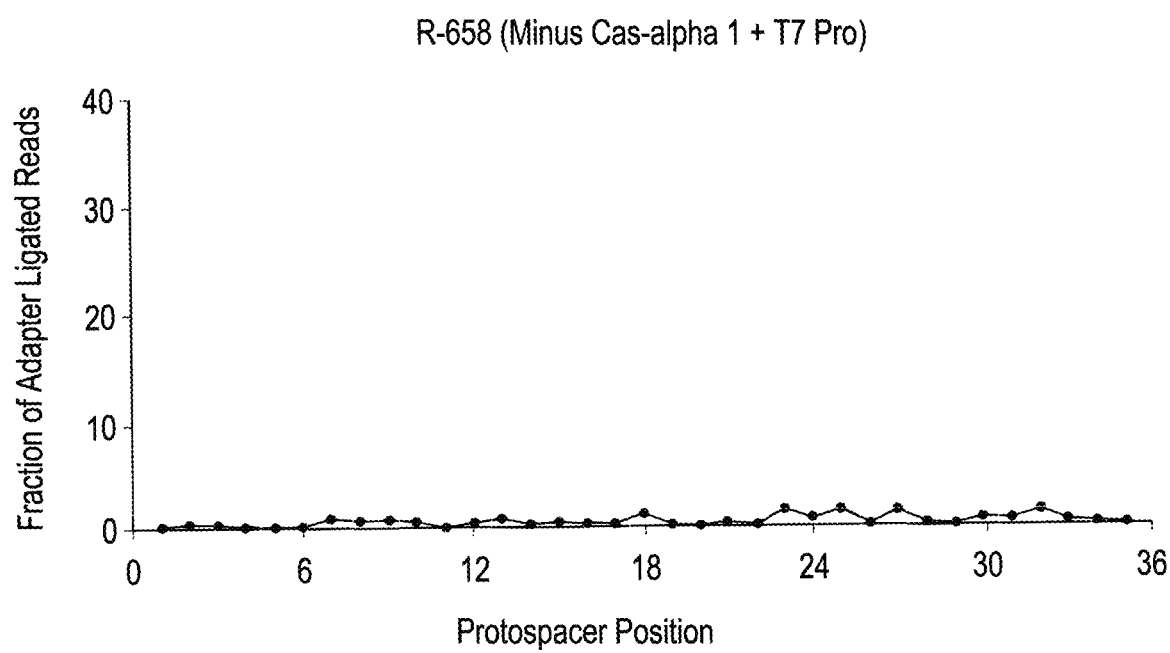

FIGS. 4A-4E show cleavage of a target polynucleotide by the Cas-alpha 1 endonuclease at nucleotide position 21. FIG. 4A shows data for the Cas-alpha 1 negative control, FIG. 4B shows data for Cas-alpha 1 using the entire (complete) CRISPR locus whose CRISPR array was modified to direct cleavage at the target polynucleotide, FIG. 4C shows the data for the Cas-alpha 1 complete locus plus when expression was enhanced using a T7 promoter, FIG. 4D shows the data for the Cas-alpha 1 minimal locus when expression was enhanced using a T7 promoter, and FIG. 4E shows the data for the reaction without Cas-alpha 1 but with the rest of the CRISPR locus when expression was enhanced with a T7 promoter.

Figure 5A:
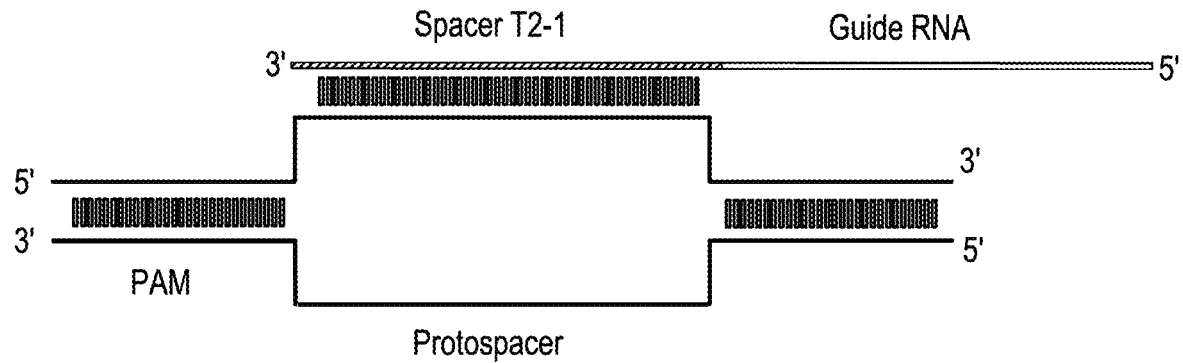
Figure 5B:
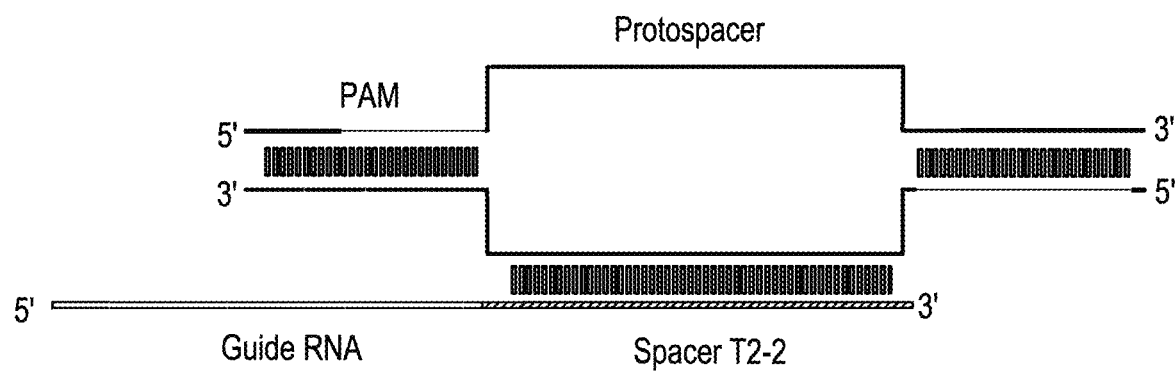

FIGS. 5A-5B depict schematics to determine the orientation of PAM recognition relative to spacer recognition, guide RNA(s) were designed to base pair with either the sense or anti-sense strands of the T2 target. If the guide RNA(s) designed to base pair with the sense strand result in the recovery of PAM preferences and yield a cleavage signal, then the protospacer is on the anti-sense strand and PAM recognition occurs 3' relative to it (FIG. 5A). Conversely, if the guide RNA(s) designed to base pair with the anti-sense strand produce PAM preferences and a cleavage signal, then the protospacer is on the sense strand and PAM recognition occurs in an orientation 5' to it (FIG. 5B).

Figure 6A:
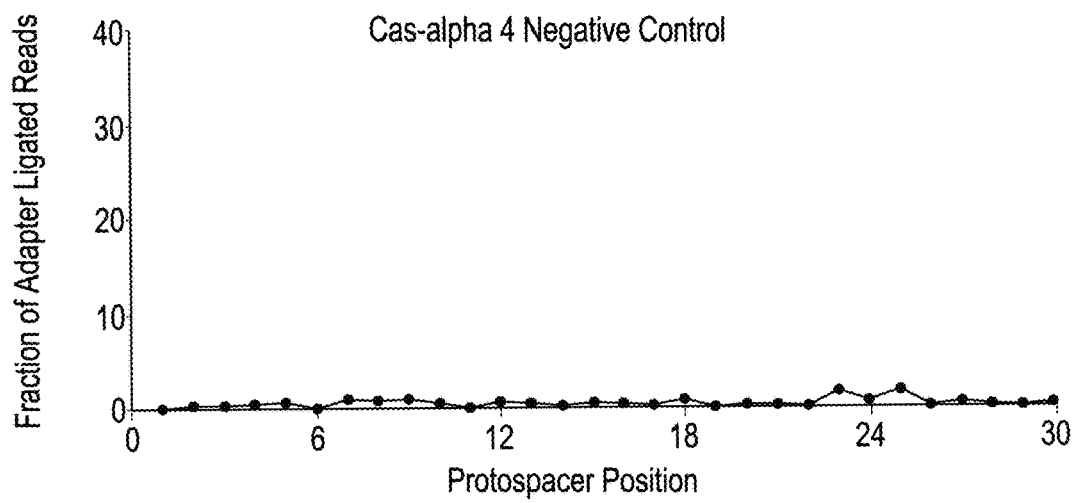
Figure 6B:
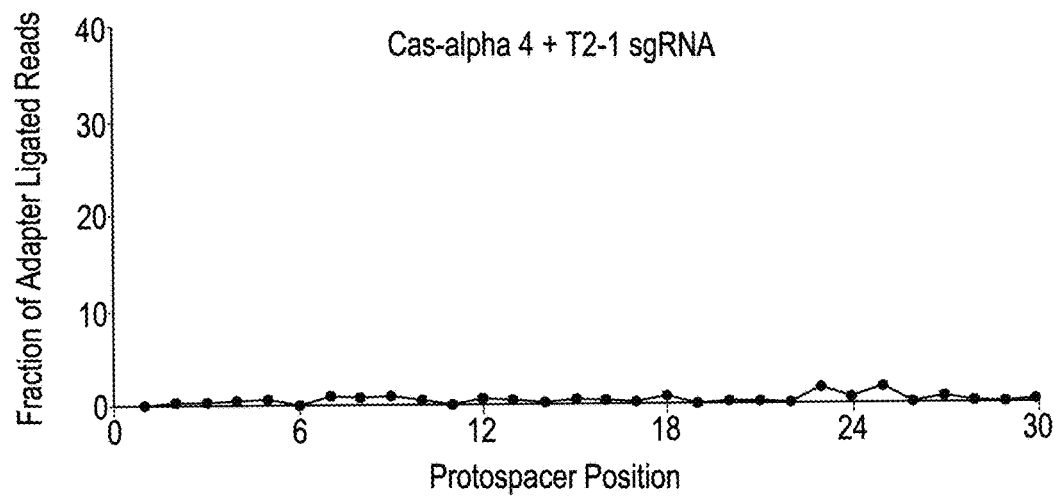
Figure 6C:
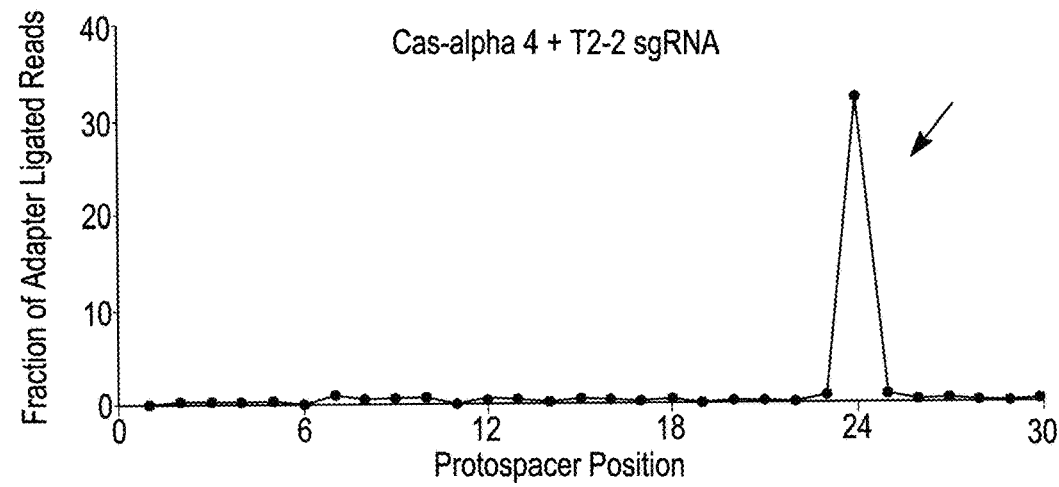
Figure 6D:
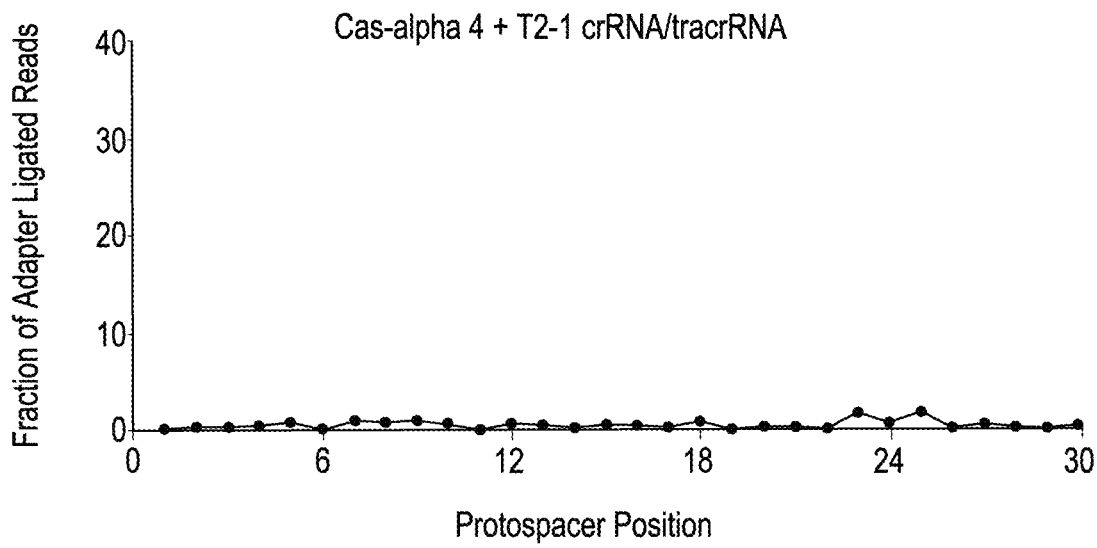
Figure 6E:
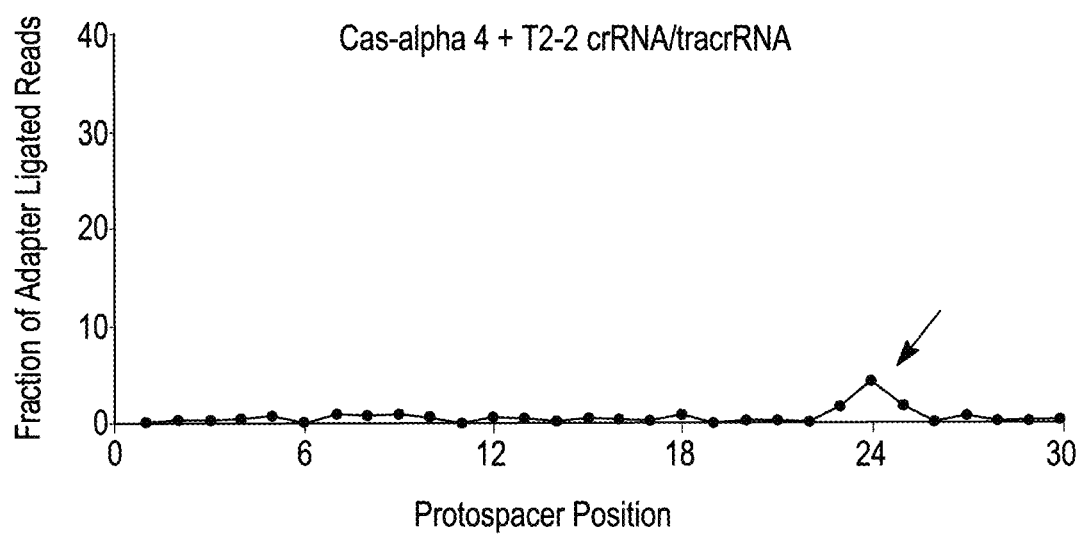

FIGS. 6A-6E show cleavage of a target polynucleotide by the Cas-alpha 4 endonuclease at nucleotide position 24. FIG. 6A shows the data for the Cas-alpha 4 negative control. FIG. 6B shows the data for Cas-alpha 4 plus the T2-1 sgRNA. FIG. 6C shows the data for Cas-alpha 4 plus the T2-2 sgRNA. FIG. 6D shows the data for Cas-alpha 4 plus T2-1 crRNA/tracrRNA. FIG. 6E shows the data for the Cas-alpha 4 plus T2-2 crRNA/tracrRNA.

FIGS. 7A-7K show representative Cas-alpha loci, endonucleases, proteins, guide RNA components, and other sequences that have been identified from a variety of bacterial and archaebacterial organisms, including: *Candidatus Micrarchaeota* archaeon (FIGS. 7A, 7B, 7E), *Candidatus Aureabacteria* bacterium (FIG. 7C), various uncultured bacteria (FIGS. 7D, 7F), *Parageobacillus thermoglucosidasius* (FIG. 7G), *Acidibacillus sulfuroxidans* (FIG. 7H), *Ruminococcus* sp. (FIG. 7I), *Syntrophomonas palmitatica* (FIG. 7J), and *Clostridium novyi* (FIG. 7K).

FIGS. 8A-8K shows distinct structural features in the representative Cas-alpha proteins, with the protein sequence in bold text. The non-bold characters beneath each amino acid residue indicate the likely secondary structure feature, with C representing a non-structured element or coil, E representing a beta strand, and H representing an alpha helix. Zinc finger domains are depicted by dashed line boxes, and stars denote key amino acid residues involved in zinc ion binding. RuvC subdomains of the split RuvC domains are depicted by solid line boxes. A bridge helix is depicted by dotted-dashed line boxes. Coiled coils are depicted by solid line cylinders. Solid plus signs denote key catalytic residues characteristic of RuvC domain motifs. FIG. 8A depicts Cas-alpha 1 from *Candidatus Micrarchaeota* archaeon (SEQ ID NO:17), FIG. 8B depicts Cas-alpha 2 from *Candidatus Micrarchaeota* archaeon (SEQ ID NO:18), FIG. 8C depicts Cas-alpha 3 from *Candidatus Aureabacteria* bacterium (SEQ ID NO:19), FIG. 8D depicts Cas-alpha 4 from an uncultured bacterium (SEQ ID NO:20), FIG. 8E depicts Cas-alpha 5 from *Candidatus Micrarchaeota* archaeon (SEQ ID NO:32), FIG. 8F depicts Cas-alpha 6 from an uncultured bacterium (SEQ ID NO:33), FIG. 8G depicts Cas-alpha 7 from *Parageobacillus thermoglucosidasius* (SEQ ID NO:34), FIG. 8H depicts Cas-alpha 8 from *Acidibacillus sulfuroxidans* (SEQ ID NO:35), FIG. 8I depicts Cas-alpha 9 from *Ruminococus* sp. (SEQ ID NO:36), FIG. 8J depicts Cas-alpha1 0 from *Syntrophomonas palmitatica* (SEQ ID NO:37) which features a unique motif of three zinc finger domains, FIG. 8K depicts Cas-alpha 11 from *Clostridium novyi* (SEQ ID NO:38). Whole genome sequencing of the organism comprising Cas-alpha 11 showed that the Cas-alpha locus was the only CRISPR system in that organism.

Figure 9A:
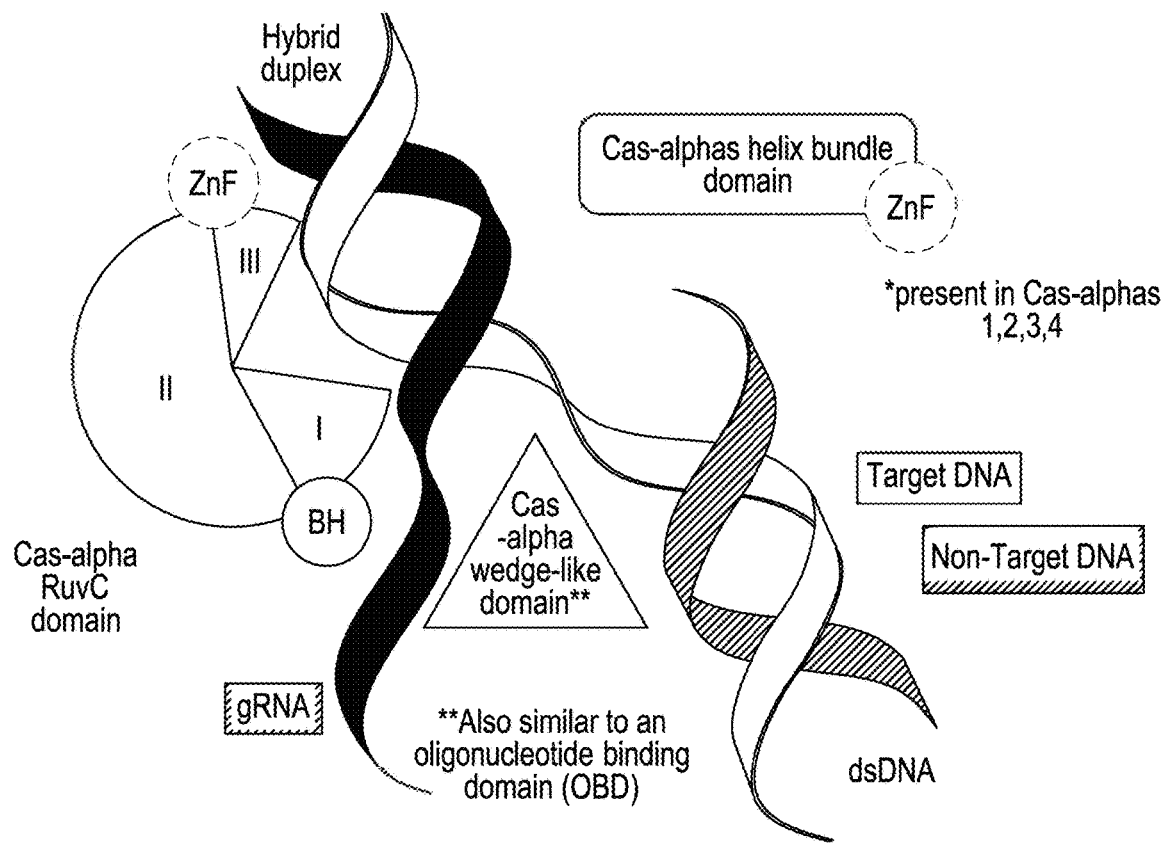
Figure 9B:
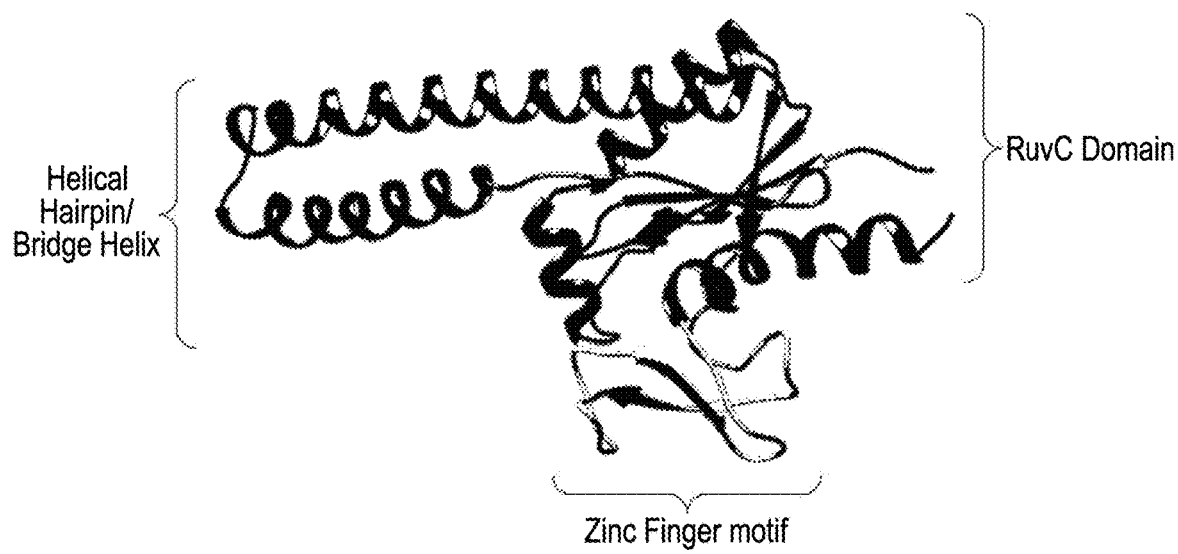

FIG. 9A depicts how the Cas-alpha protein subunits interact with the hybrid duplex of the target DNA and the guide RNA. FIG. 9B is a three-dimensional model of the C-terminal half of Cas-alpha 4, showing the regions identified as the Helical Hairpin/Bridge Helix region common to Cas proteins, the RuvC domain, and the Zinc Finger motif.

Figure 10A:
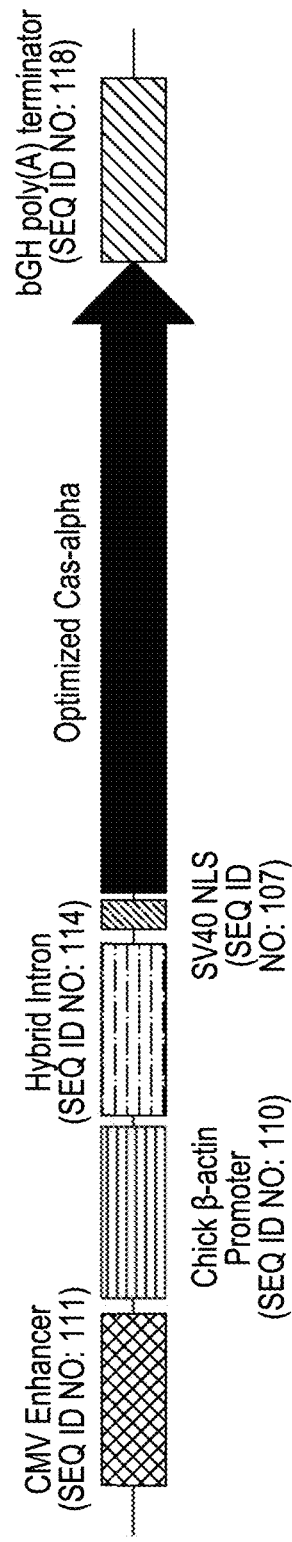
Figure 10B:
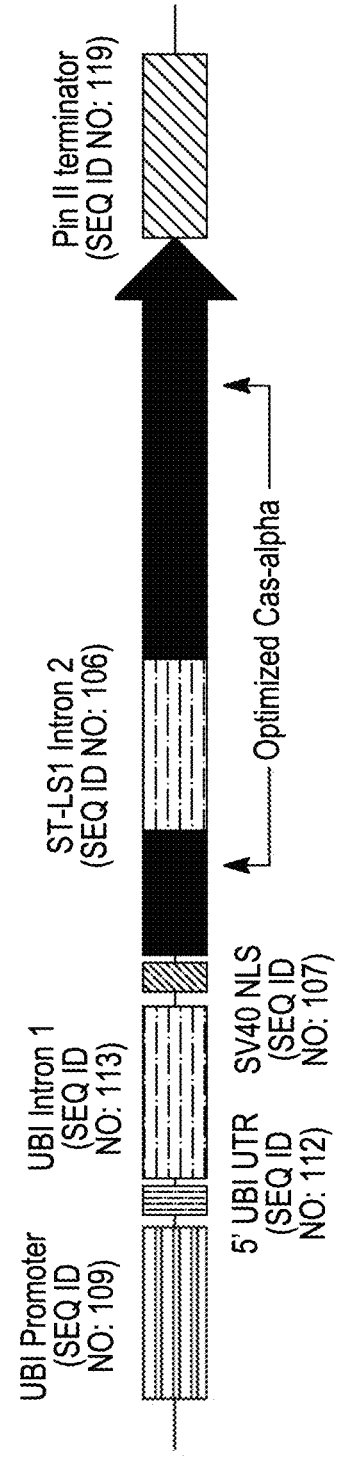

FIGS. 10A-10D depict example expression constructs for use of a Cas-alpha endonuclease in a eukaryotic cell. FIG. 10A is an example of a human cell Cas-alpha DNA expression construct. FIG. 10B is an example of a plant cell Cas-alpha DNA expression construct. FIG. 10C is an example of a yeast (*Saccharomyces cerevisiae*) Cas-alpha DNA expression construct. FIG. 10D is an example of an inducible yeast (*Saccharomyces cerevisiae*) Cas-alpha DNA expression construct.

Figure 11A:
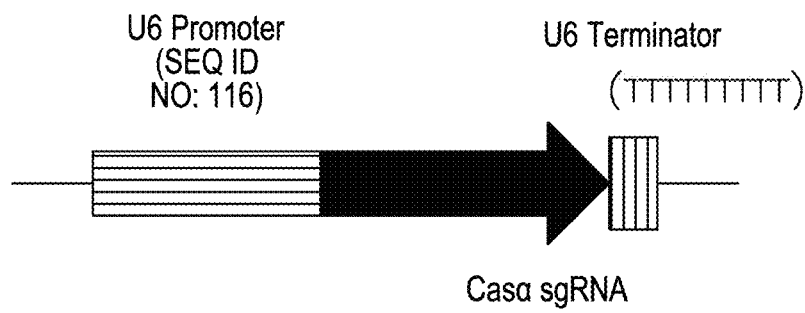
Figure 11B:
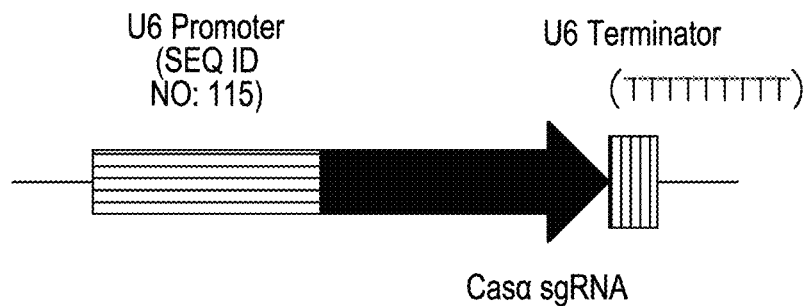
Figure 11C:
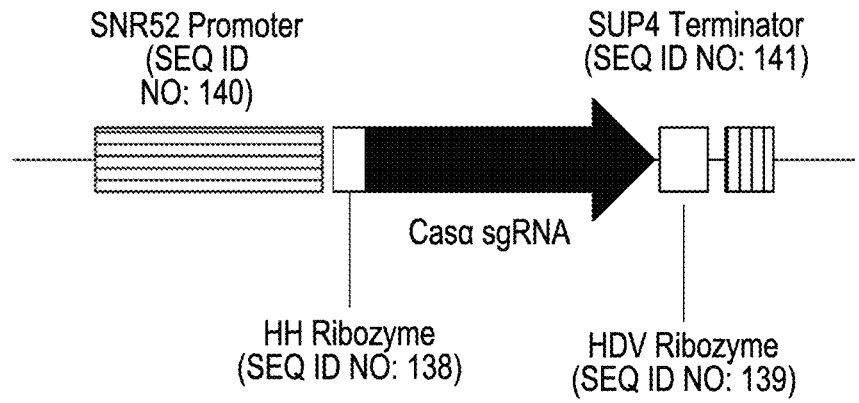
Figure 11D:
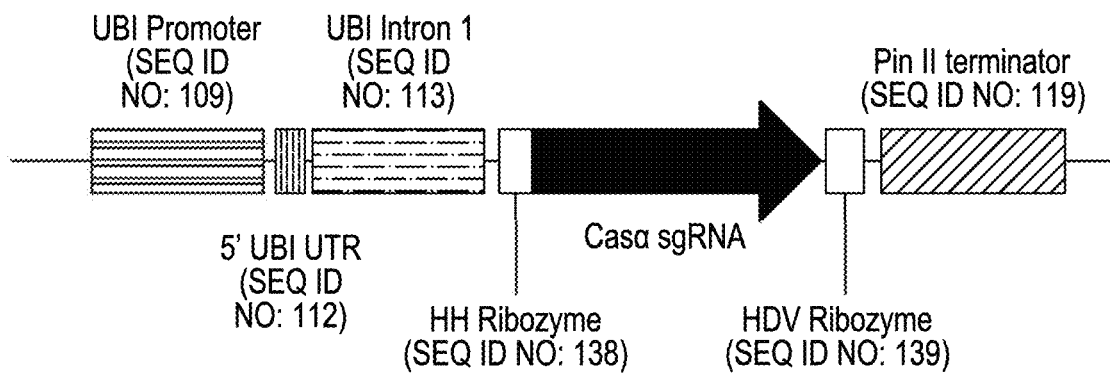

FIGS. 11A-11D depicts examples of eukaryotic optimized Cas-alpha guide RNA expression constructs. FIG. 11A is an example of a human cell single guide RNA (sgRNA) DNA expression construct. FIG. 11B is an example of a plant cell single guide RNA (sgRNA) DNA expression construct. FIG. 11C is an example of a yeast (*Saccharomyces cerevisiae*) single guide RNA (sgRNA) DNA expression construct. FIG. 11D is another example of a plant cell single guide RNA (sgRNA) DNA expression construct.

FIG. 12 depicts examples of engineered genes for recombinant expression and purification of Cas-alpha endonucleases in *E. coli*.

Figure 13:
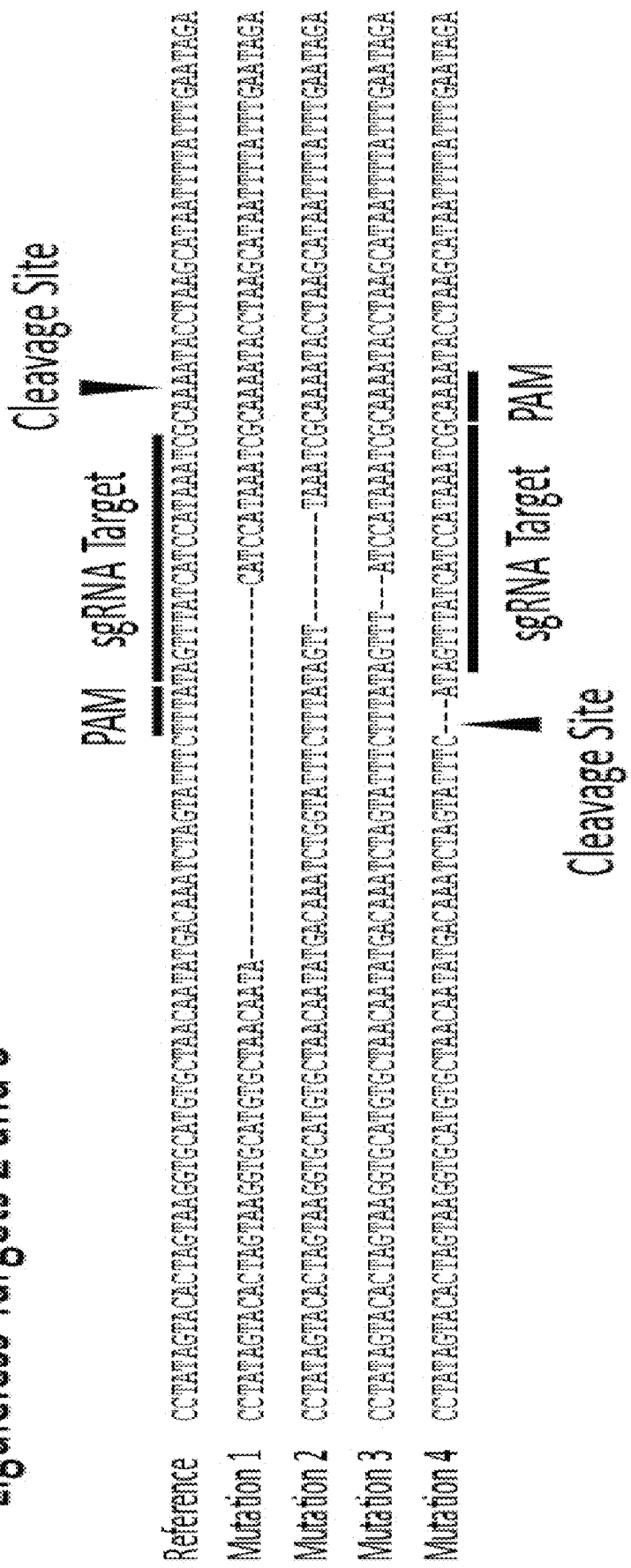

FIG. 13 shows double stranded break repair mutations in plant cells from Cas-alpha endonuclease activity. Depicted are mutations resulting from Cas-alpha 4 in *Zea mays*. The WT Reference is SEQ ID NO:120, Mutation 1 is SEQ ID NO: 121, Mutation 2 is SEQ ID NO:122, Mutation 3 is SEQ ID NO:123, and Mutation 4 is SEQ ID NO:124.

Figure 14A:
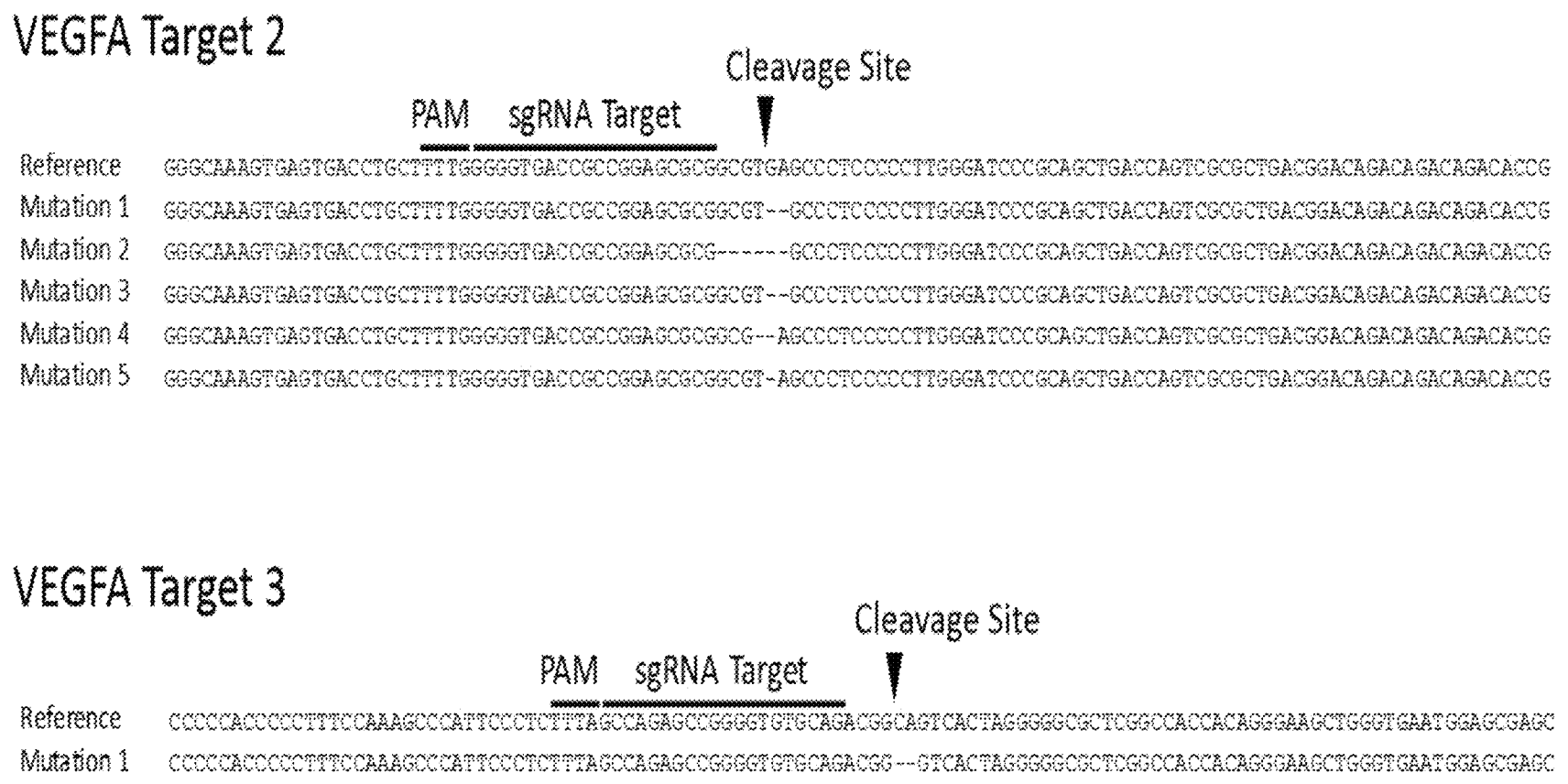
Figure 14B:
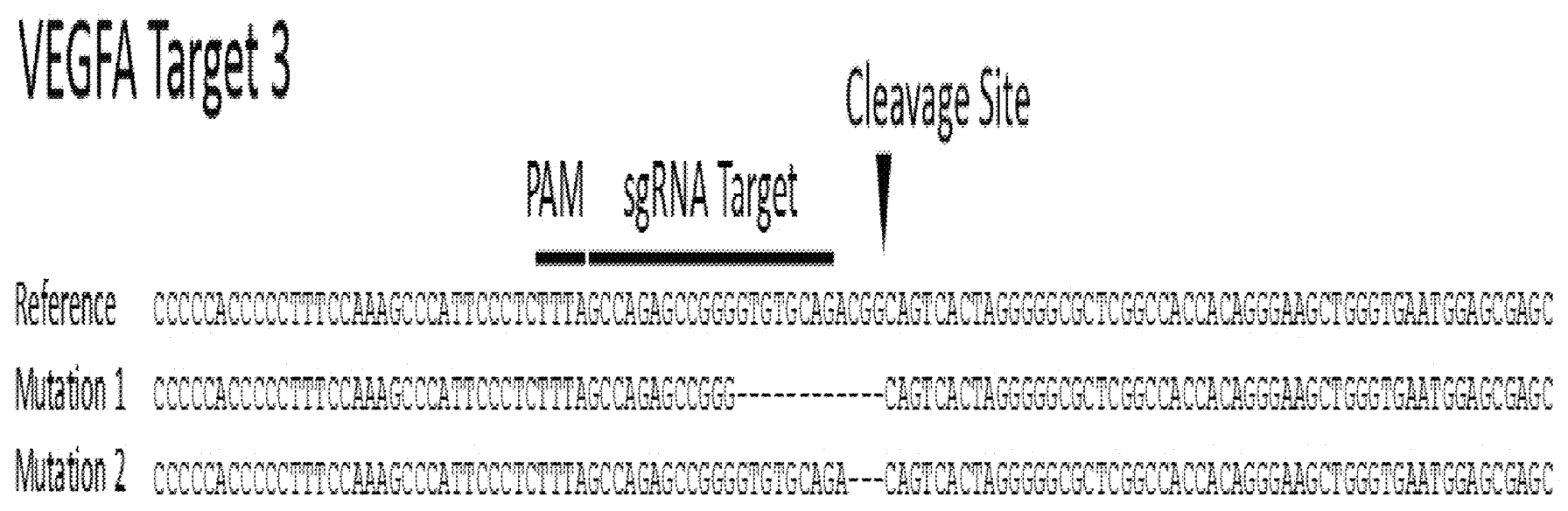

FIGS. 14A-14B show double stranded break repair mutations in animal cells from Cas-alpha endonuclease activity. FIG. 14A depicts indel mutations (VEGFA Target 2 Mutations 1-5 given as SEQ ID NOs: 127-131, compared to the WT Reference SEQ ID NO:126; VEGFA Target 3 (Mutation given as SEQ ID NO:133, compared to the WT reference SEQ ID NO:132) resulting from Cas-alpha4 RNP electroporation. FIG. 14B depicts indel mutations VEGFA Target 3 (Mutations 1 and 2 given as SEQ ID NO:134-135, compared to the WT reference SEQ ID NO:132) resulting from Cas-alpha4 and sgRNA DNA expression cassette lipofection.

Figure 15A:
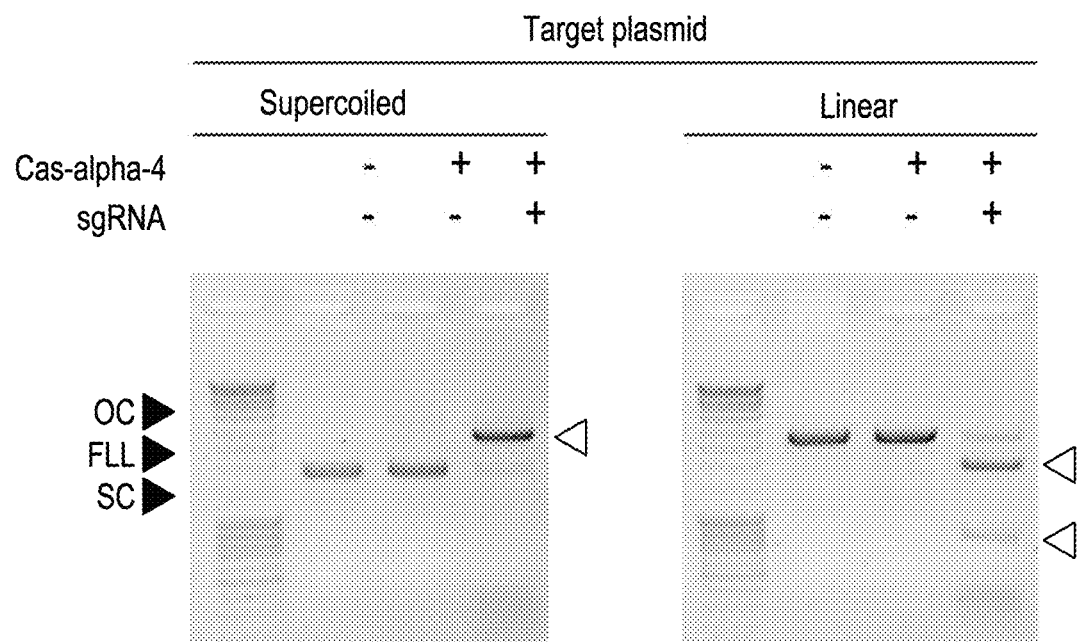
Figure 15B:
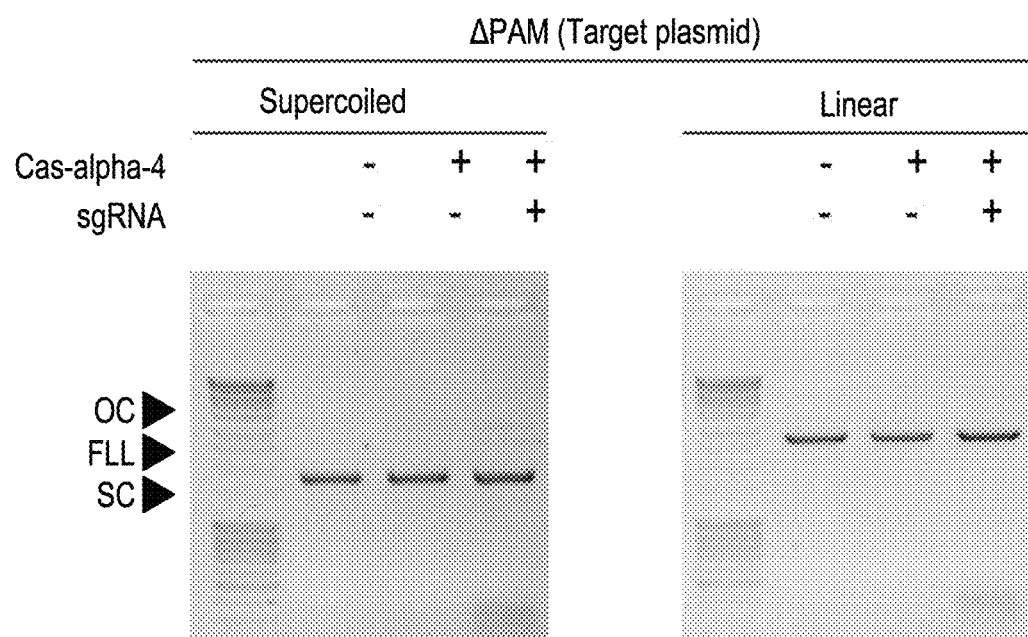
Figure 15C:
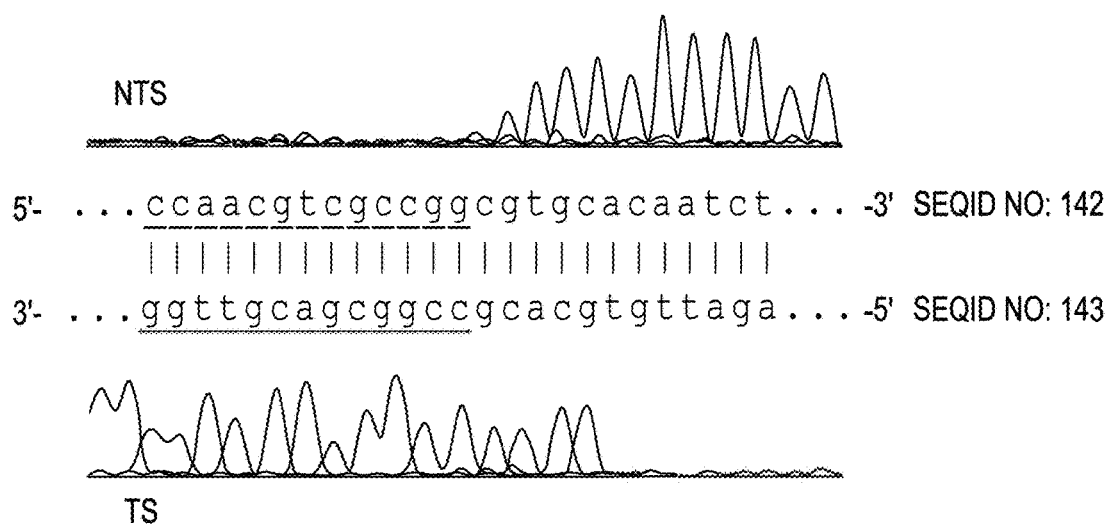
Figure 15D:
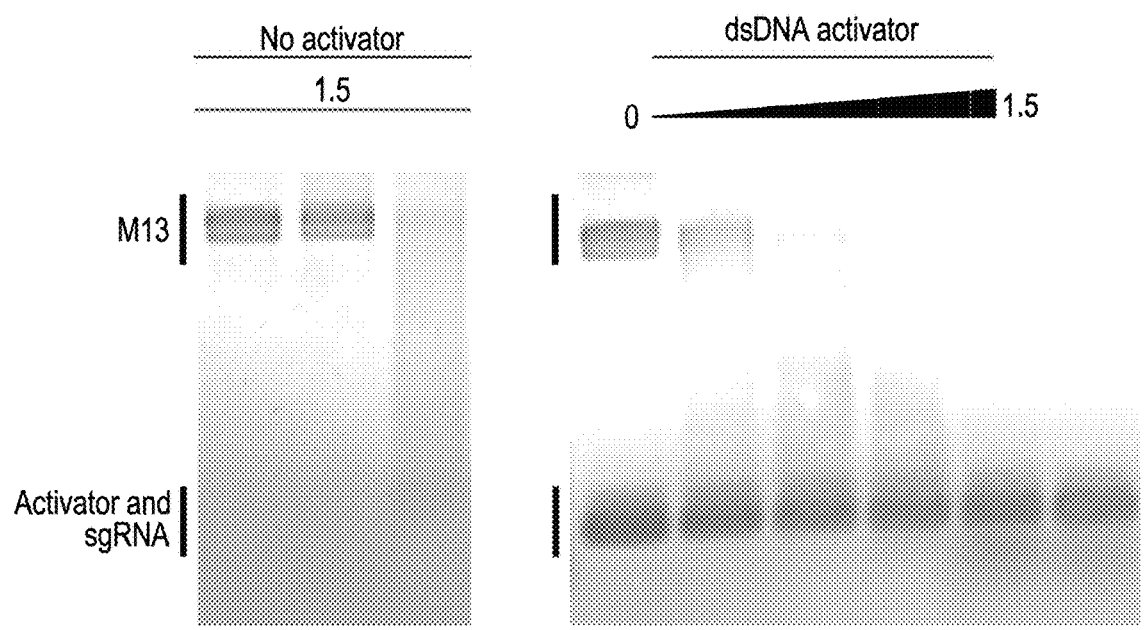

FIGS. 15A-15D show Cas-alpha4 double-stranded DNA target cleavage. FIG. 15A shows that a supercoiled (SC) plasmid DNA containing a guide RNA target (~20 bp) immediately 3' of a PAM (5'-TTTR-3' where R represented either A or G bps) was completely converted to a linear form (FLL), thus, illustrating the formation of a dsDNA break. Additionally, cleavage of linear DNA resulted in DNA fragments of an expected size further validating Cas-alpha 4 mediated dsDNA break formation. FIG. 15B shows that Cas-alpha 4 requires a PAM and guide RNA to cleave a dsDNA target. FIG. 15C shows that Cas-alpha 4 generates 5' staggered overhanging DNA cut-sites, with cleavage predominantly occurring centered around positions 20-24 bp in respect to the PAMsequence. FIG. 15D shows trans-acting ssDNase activity of Cas-alpha 4 that was activated by dsDNA only in the presence of a guide RNA.

Figure 16A:
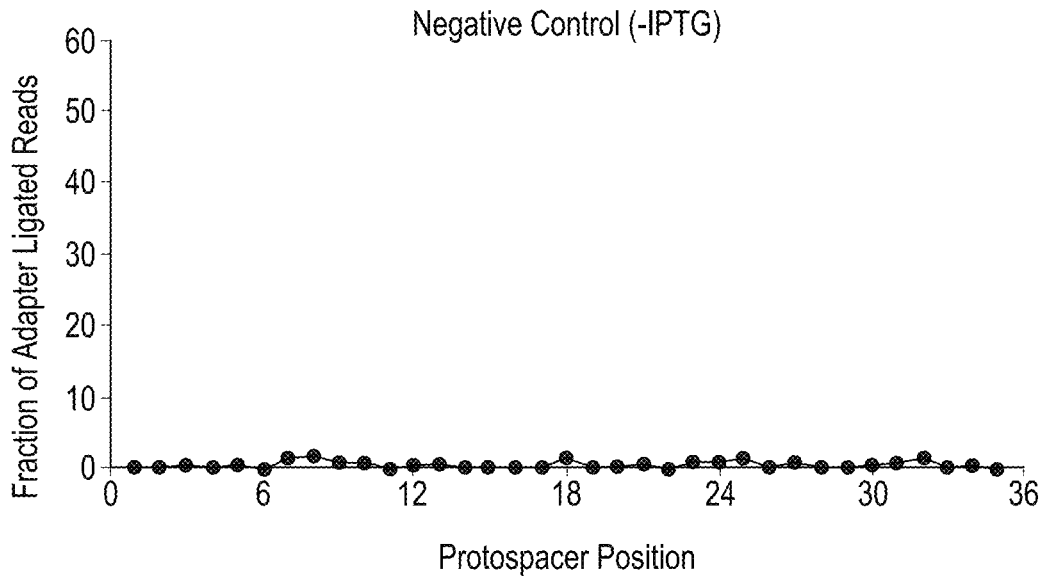
Figure 16B:
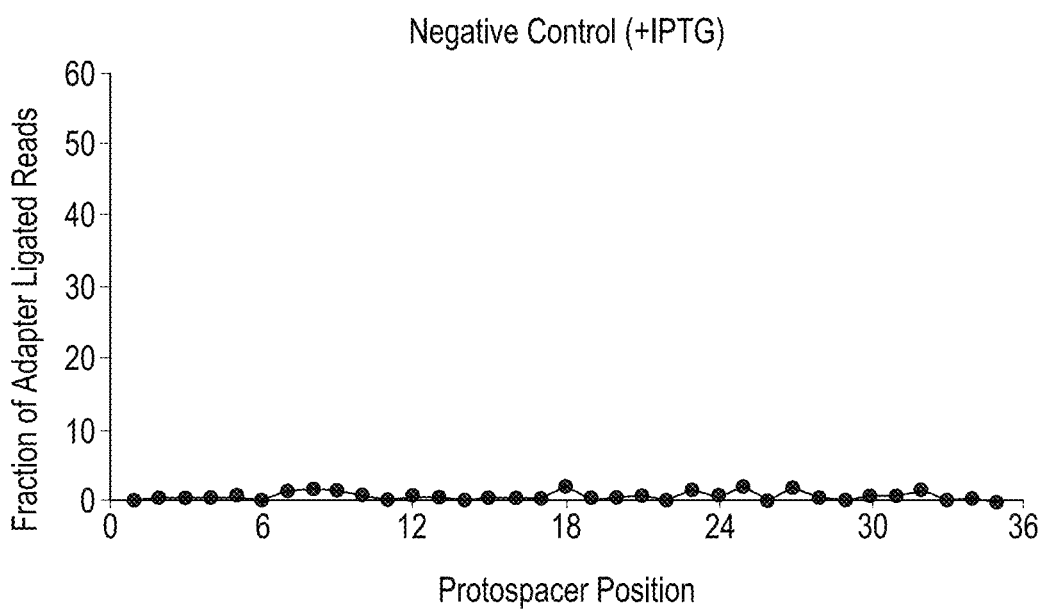
Figure 16C:
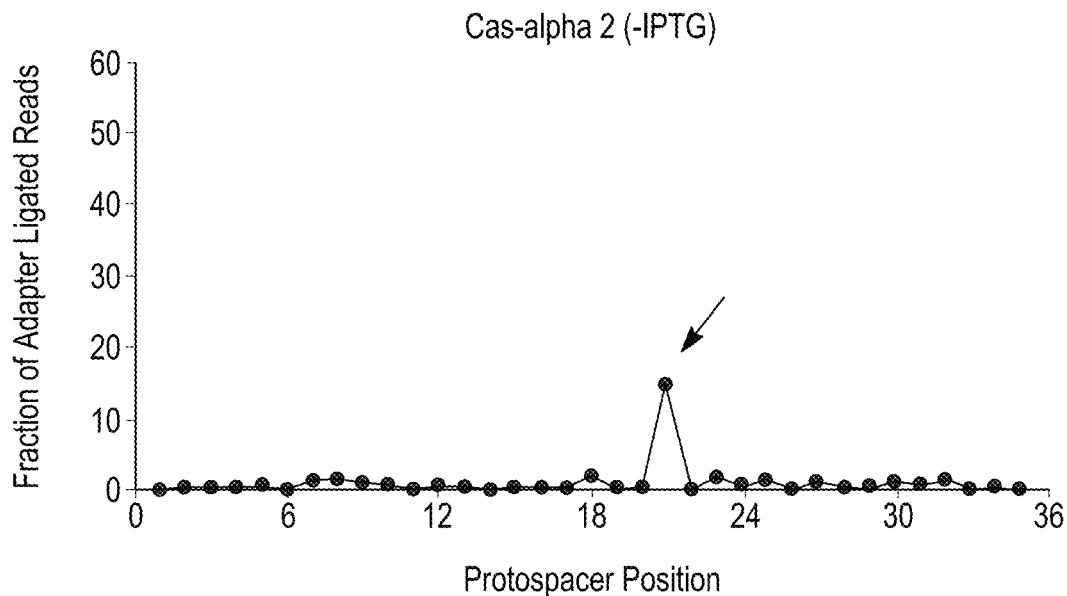
Figure 16D:
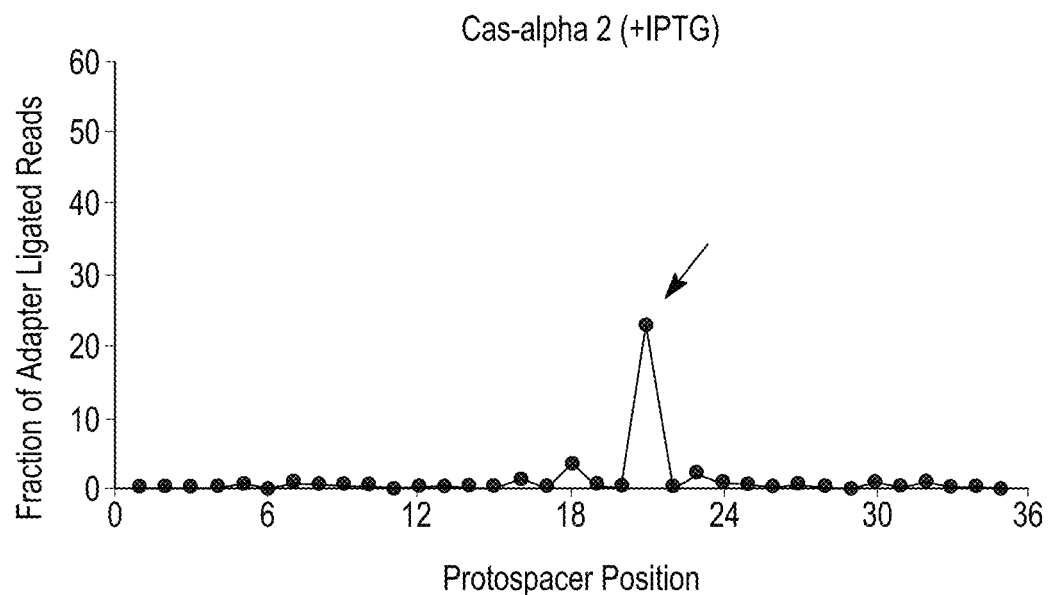
Figure 16E:
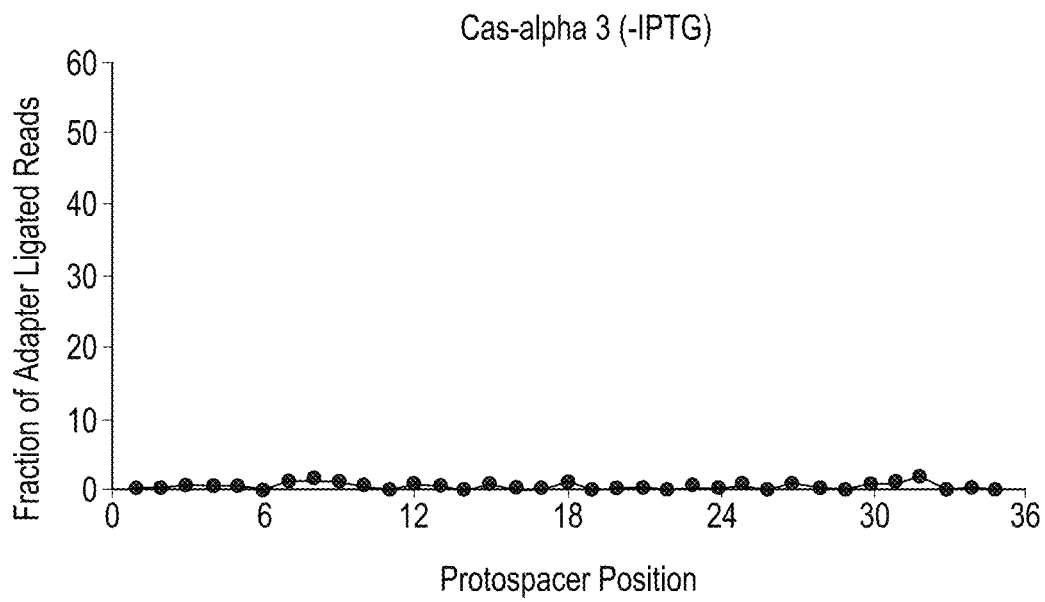
Figure 16F:
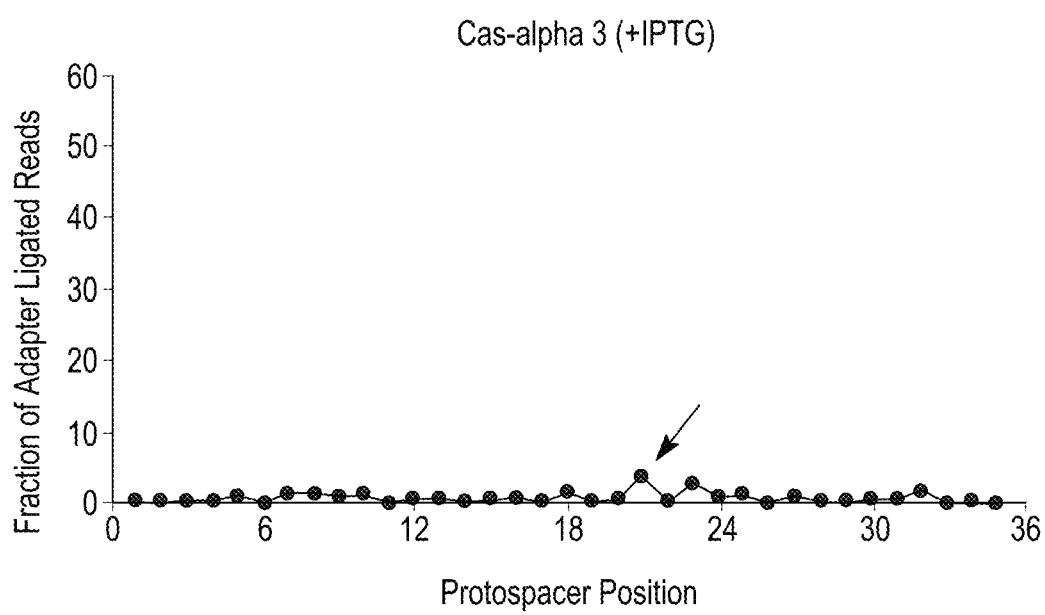
Figure 16G:
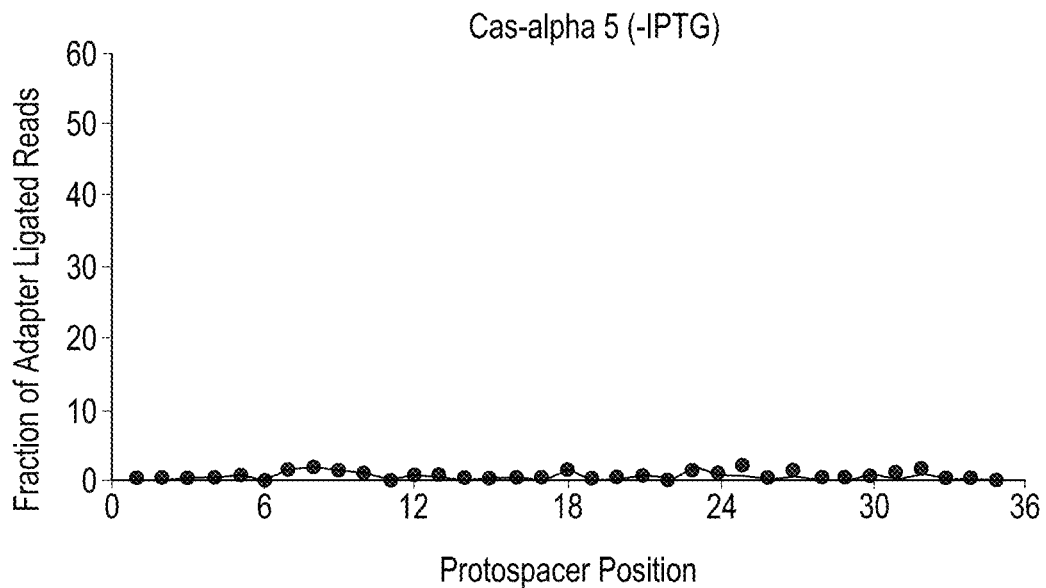
Figure 16H:
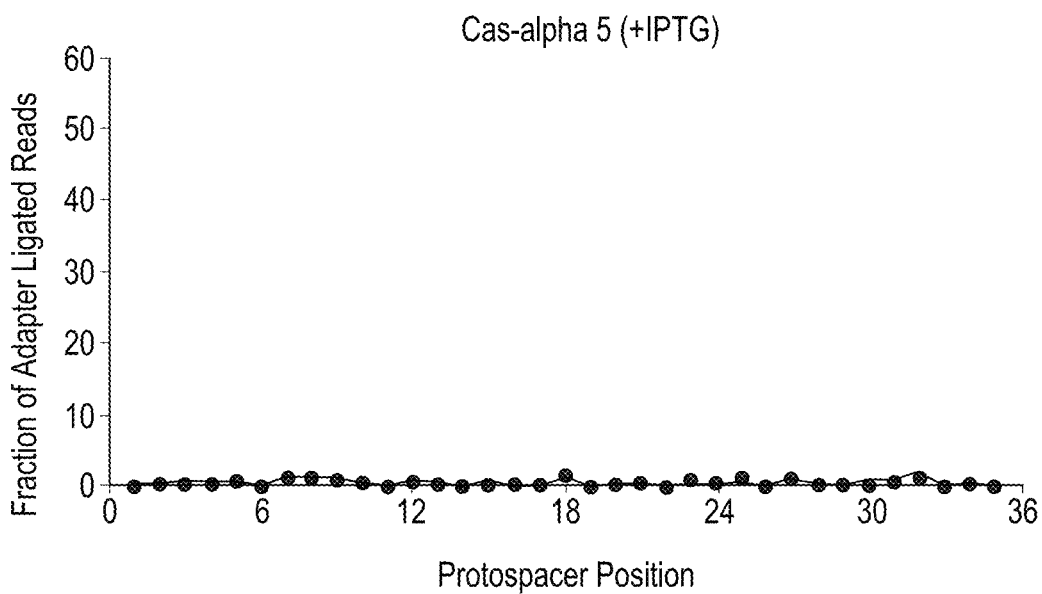
Figure 16I:
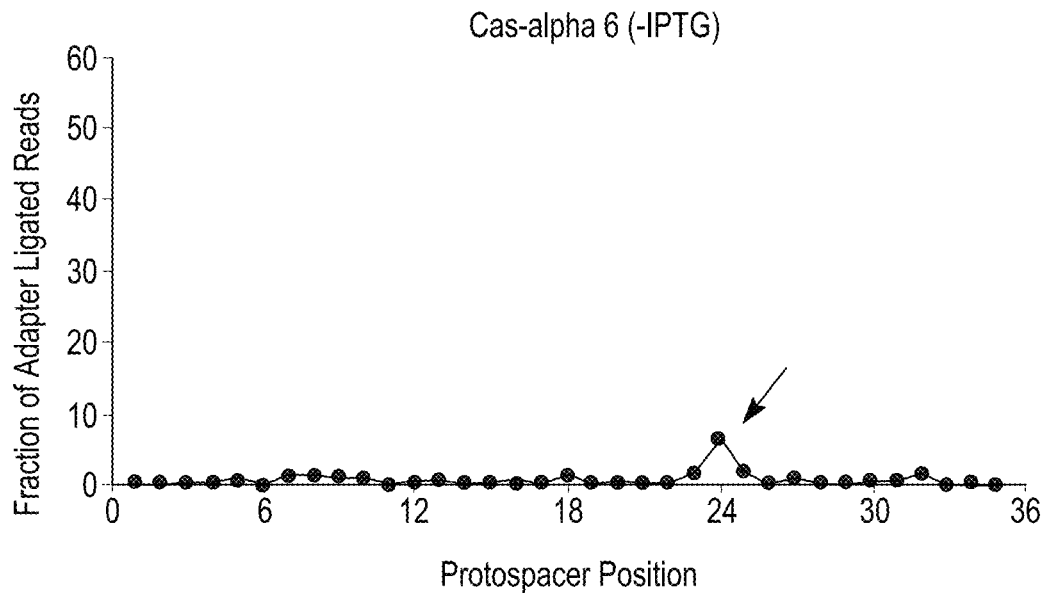
Figure 16J:
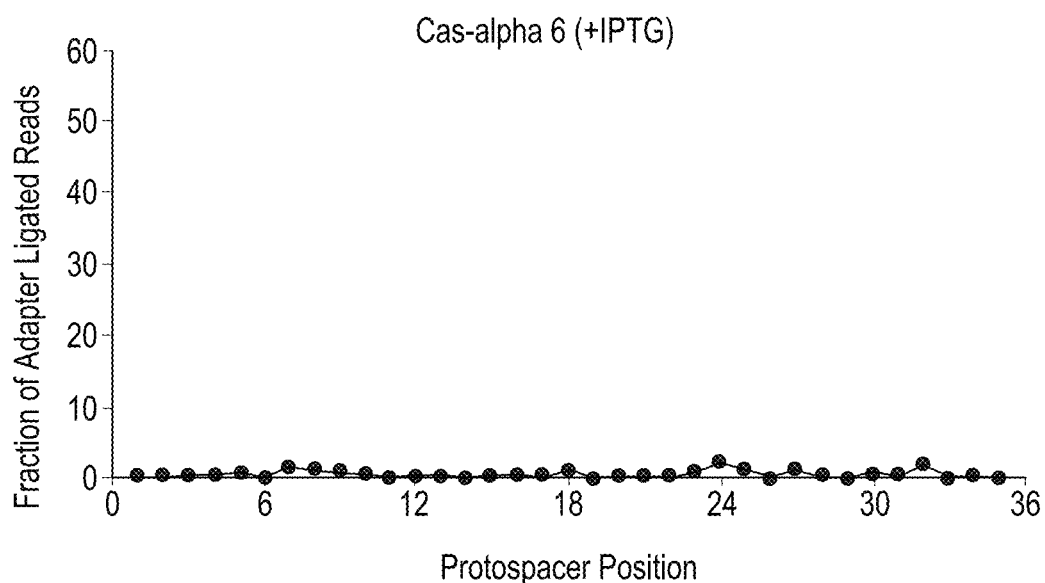
Figure 16K:
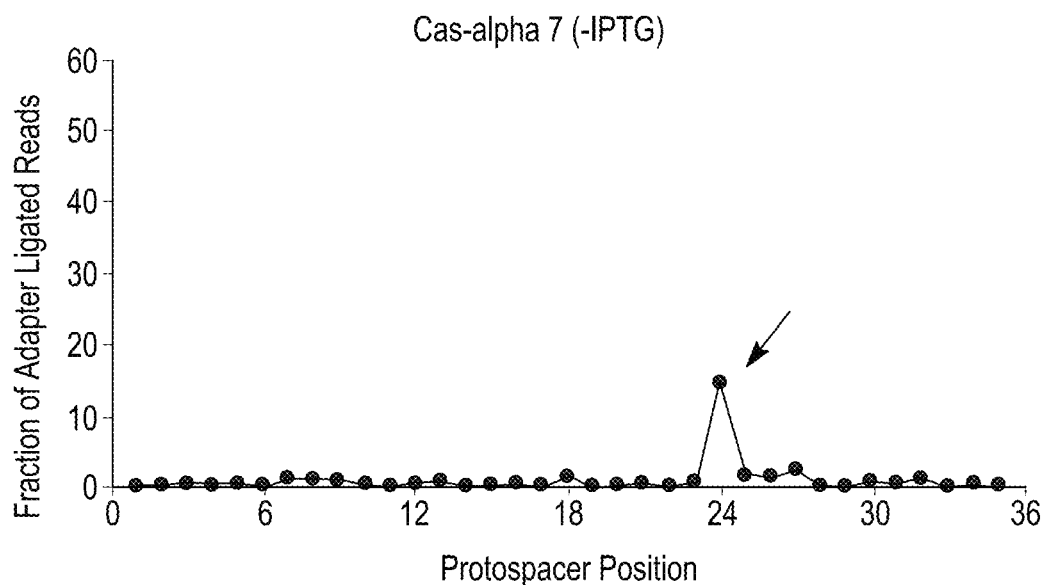
Figure 16L:
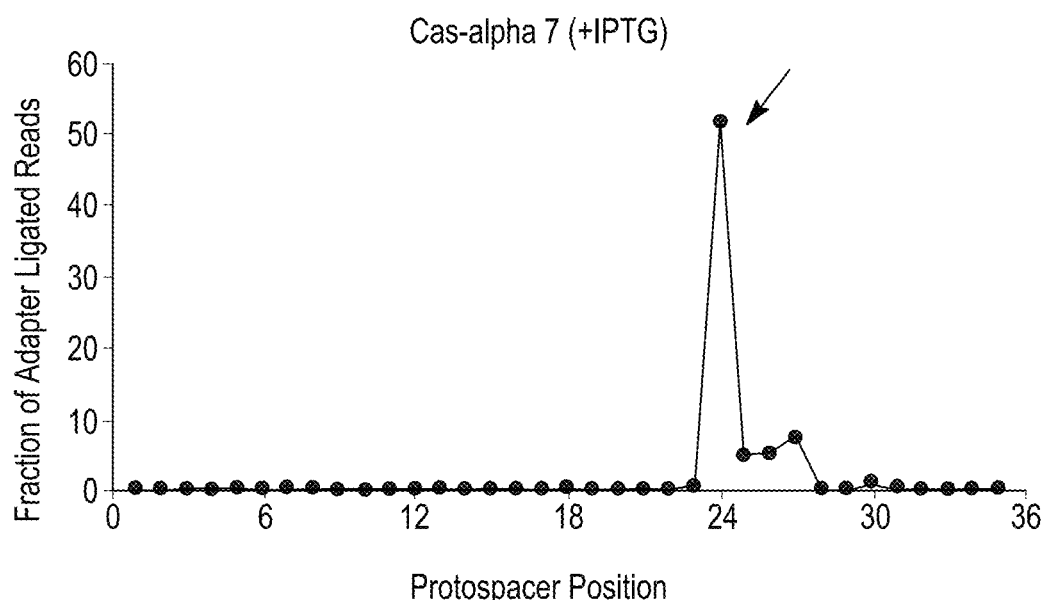
Figure 16M:
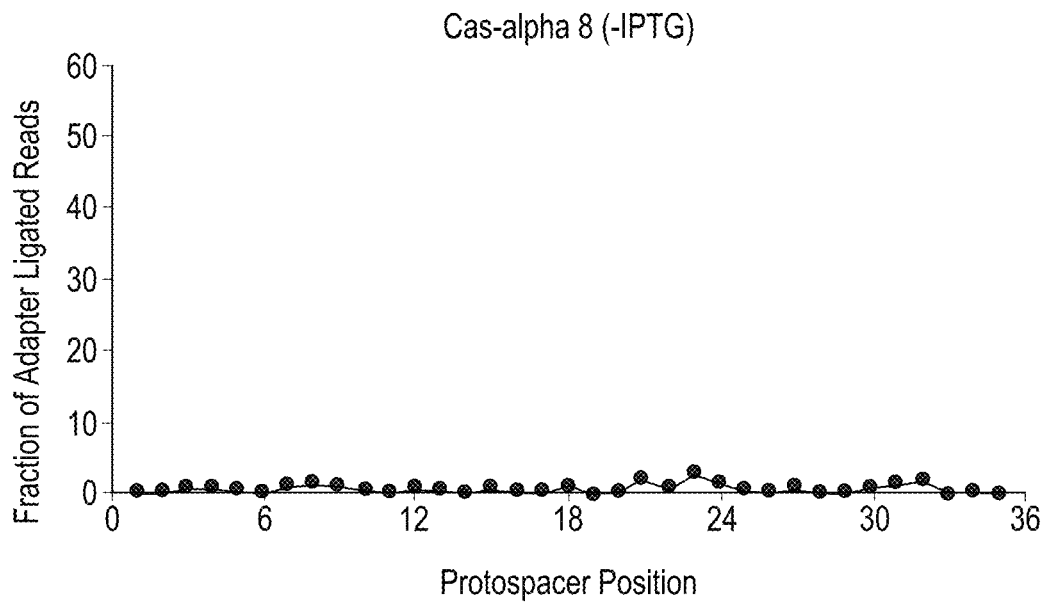
Figure 16N:
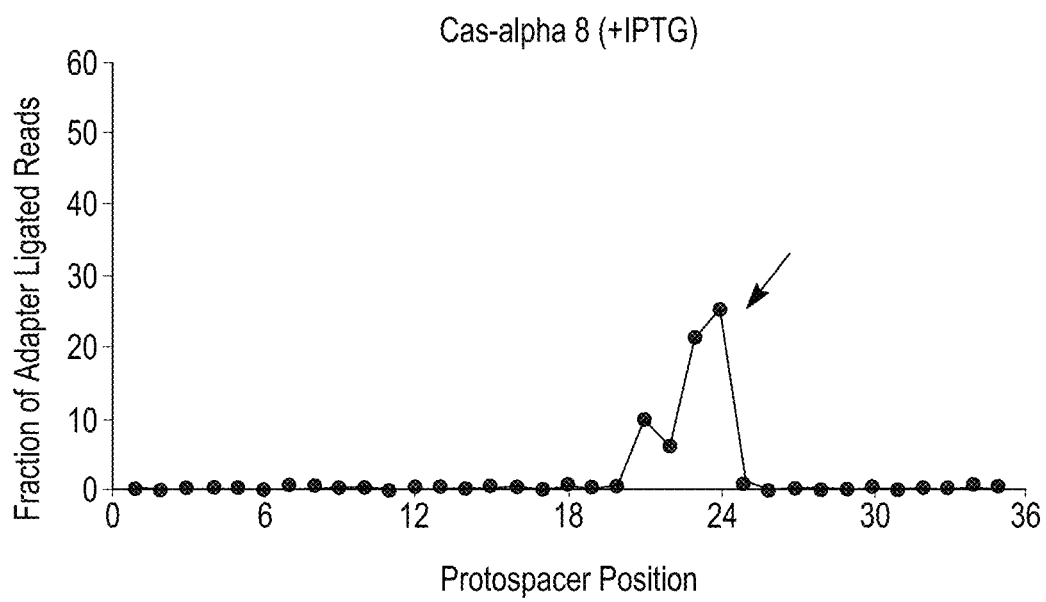
Figure 16O:
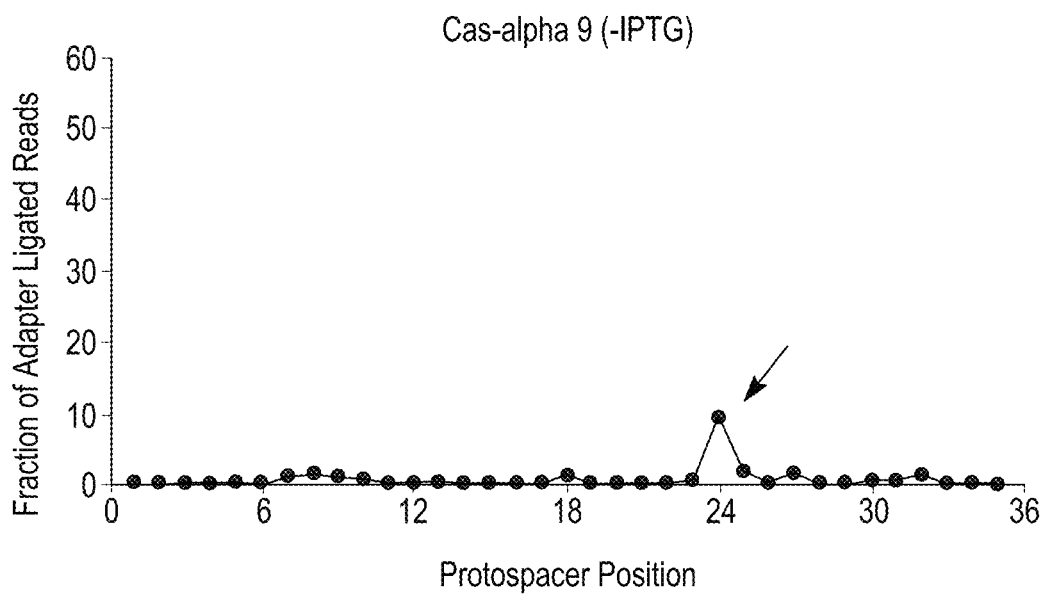
Figure 16P:
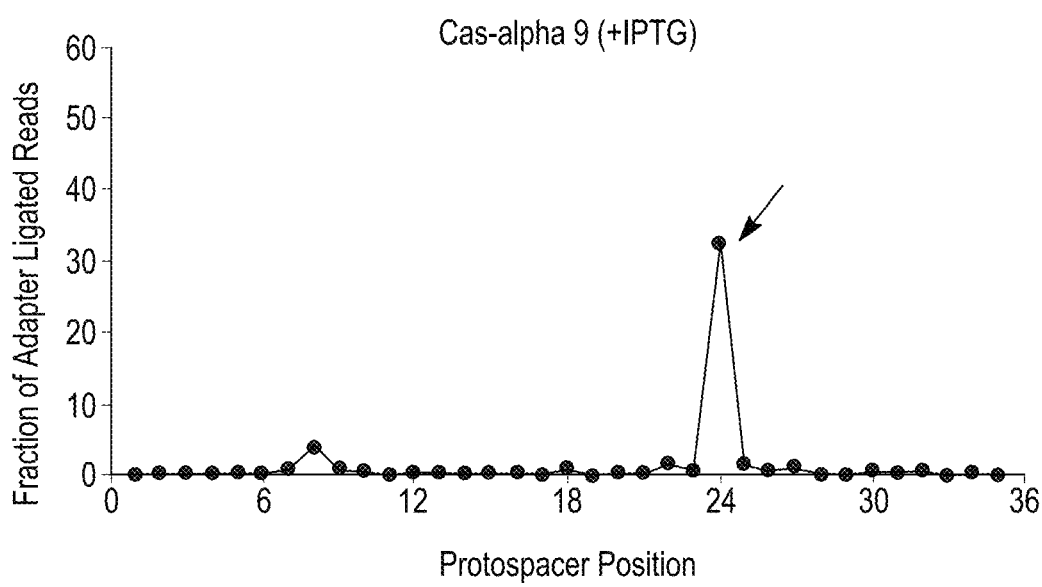
Figure 16Q:
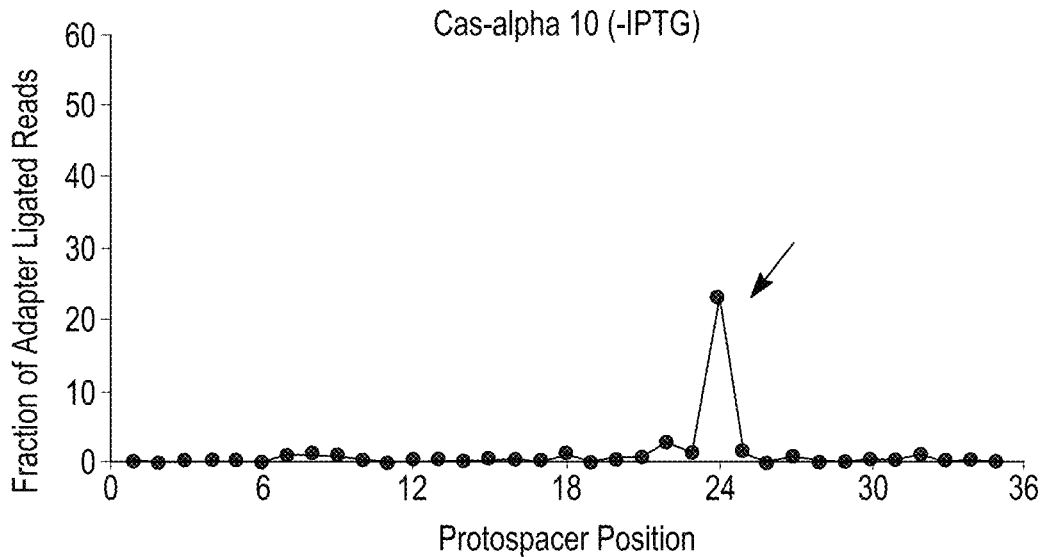
Figure 16R:
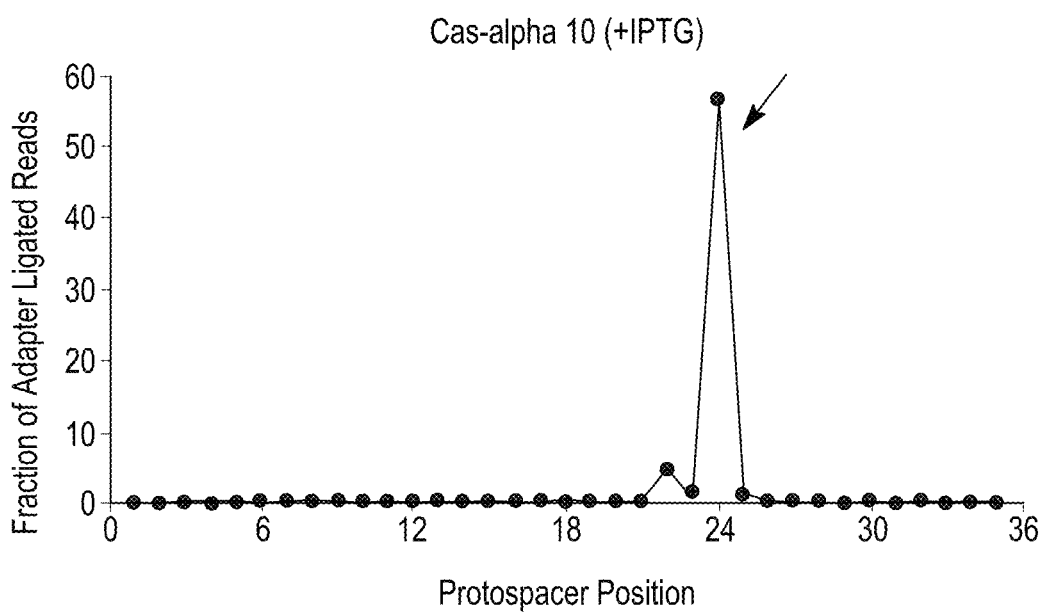
Figure 16S:
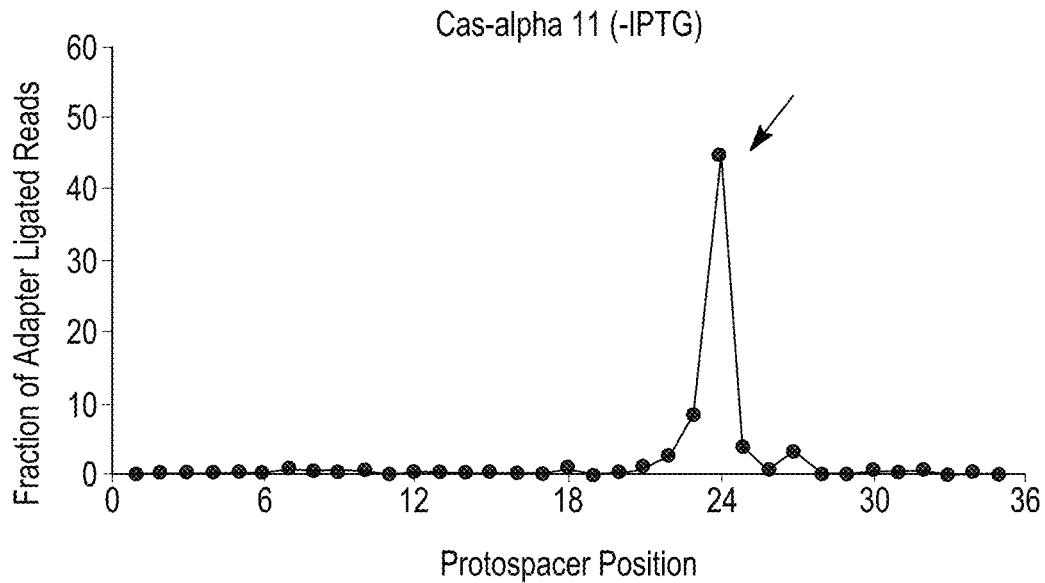
Figure 16T:
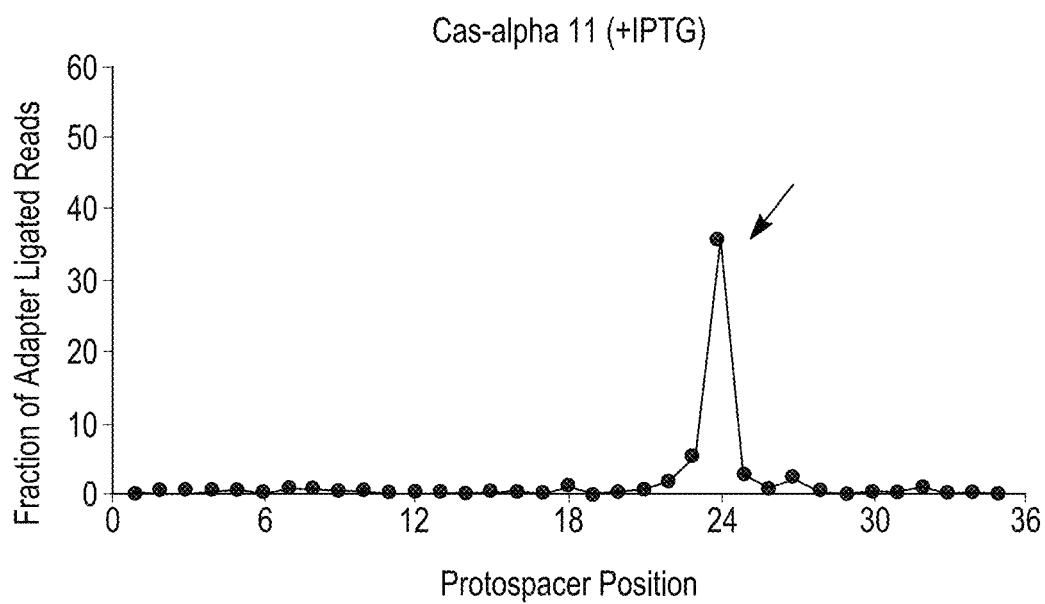

FIGS. 16A-16T show double stranded DNA target cleavage activity for all Cas-alpha endonucleases except Cas-alpha 5. FIG. 16A is a negative control (−IPTG). FIG. 16B is a negative control (+IPTG). FIG. 16C shows cleavage of a double stranded DNA target by Cas-alpha 2 (−IPTG) at protospacer position 21. FIG. 16D shows cleavage of a double-stranded DNA target by Cas-alpha2 (+IPTG) at protospacer position 21. FIG. 16E shows no cleavage of a double stranded DNA target by Cas-alpha 3 (−IPTG). FIG. 16F shows cleavage of a double stranded DNA target by Cas-alpha 3 (+IPTG) at protospacer position 21. FIG. 16G shows no cleavage of a double stranded DNA target by Cas-alpha 5 (−IPTG). FIG. 16H shows no cleavage of a double stranded DNA target by Cas-alpha 5 (−IPTG). FIG. 16I shows cleavage of a double stranded DNA target by Cas-alpha 6 (−IPTG). FIG. 16J shows no cleavage of a double stranded DNA target by Cas-alpha 6 (+IPTG) at protospacer position 24. FIG. 16K shows cleavage of a double stranded DNA target by Cas-alpha 7 (−IPTG) at protospacer position 24. FIG. 16L shows cleavage of a double stranded DNA target by Cas-alpha 7 (+IPTG) at protospacer position 24. FIG. 16M shows no cleavage of a double-stranded DNA target by Cas-alpha8 (−IPTG). FIG. 16N shows cleavage of a double stranded DNA target by Cas-alpha 8 (+IPTG) at protospacer position 24. FIG. 16O shows cleavage of a double stranded DNA target by Cas-alpha 9 (−IPTG) at protospacer position 24. FIG. 16P shows cleavage of a double stranded DNA target by Cas-alpha9 (+IPTG) at protospacer position 24. FIG. 16Q shows cleavage of a double stranded DNA target by Cas-alpha 10 (−IPTG) at protospacer position 24. FIG. 16R shows cleavage of a double stranded DNA target by Cas-alpha 10 (+IPTG) at protospacer position 24. FIG. 16S shows cleavage of a double stranded DNA target by Cas-alpha 11 (−IPTG) at protospacer position 24. FIG. 16T shows cleavage of a double stranded DNA target by Cas-alpha 11 (+IPTG) at protospacer position 24.

Figure 17A:
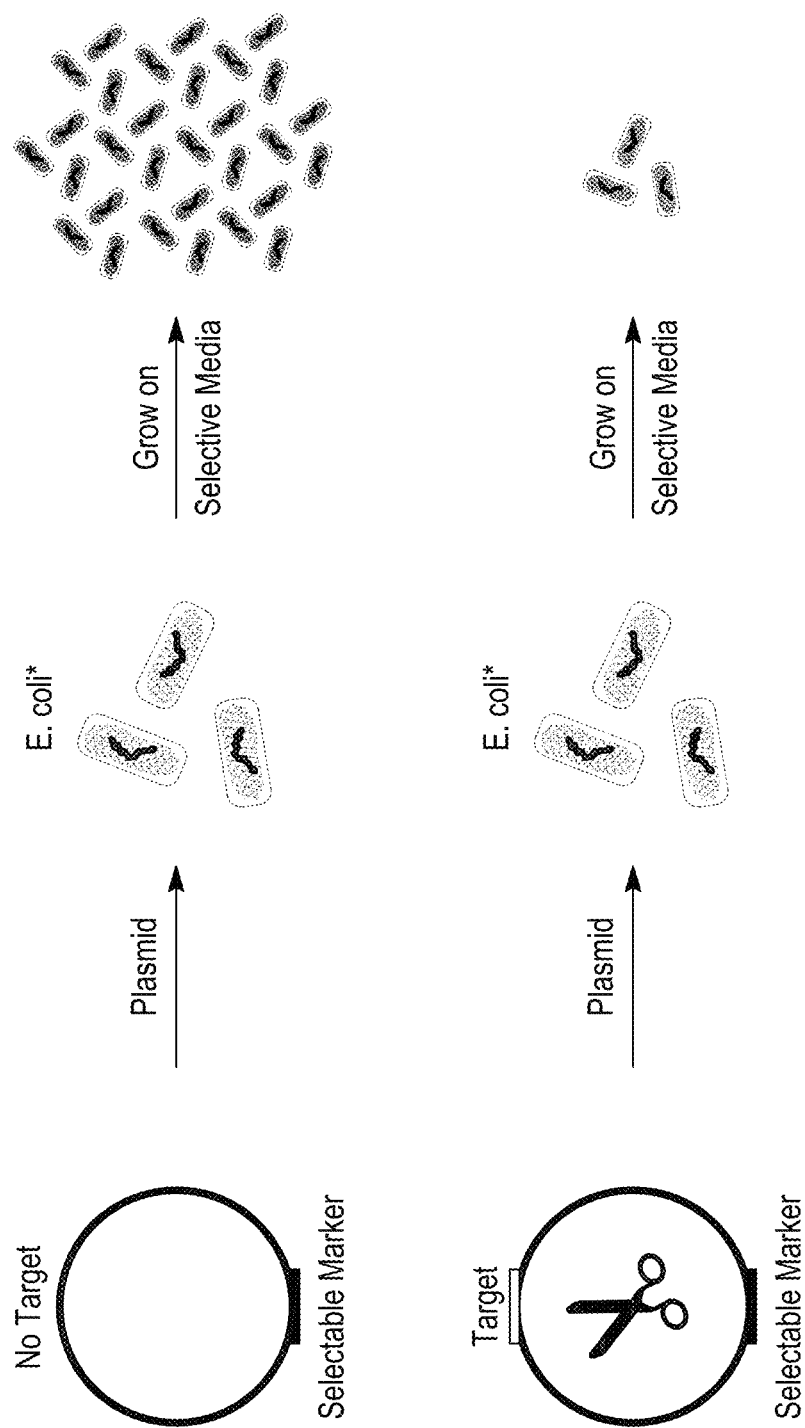
Figure 17B:
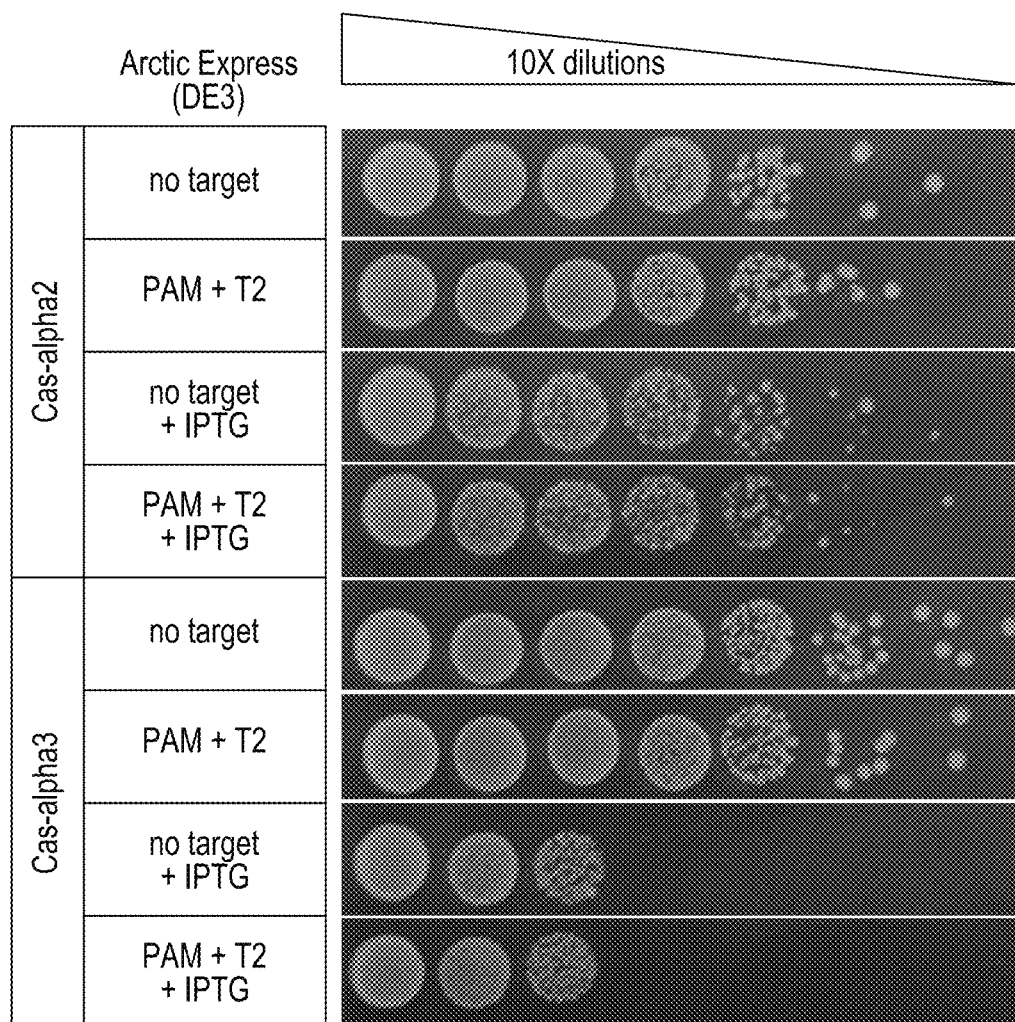
Figure 17C:
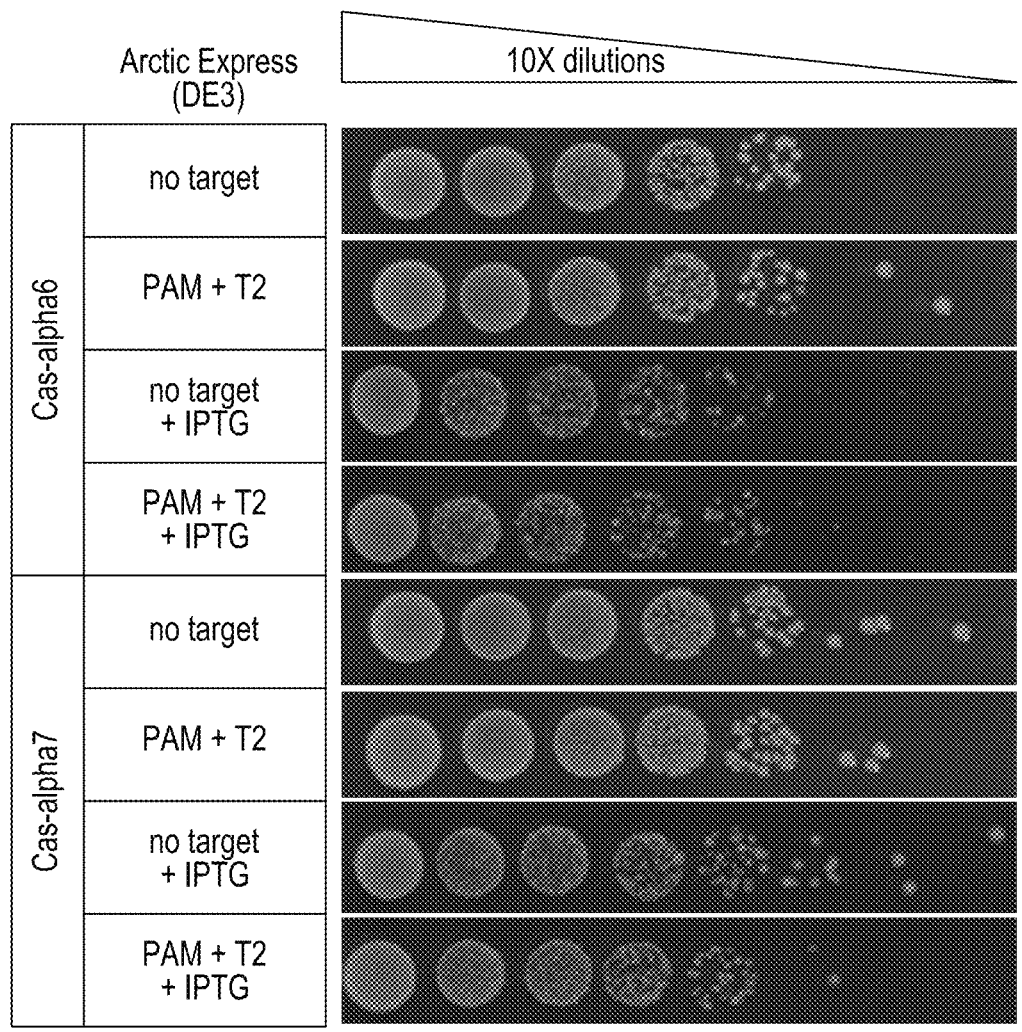
Figure 17D:
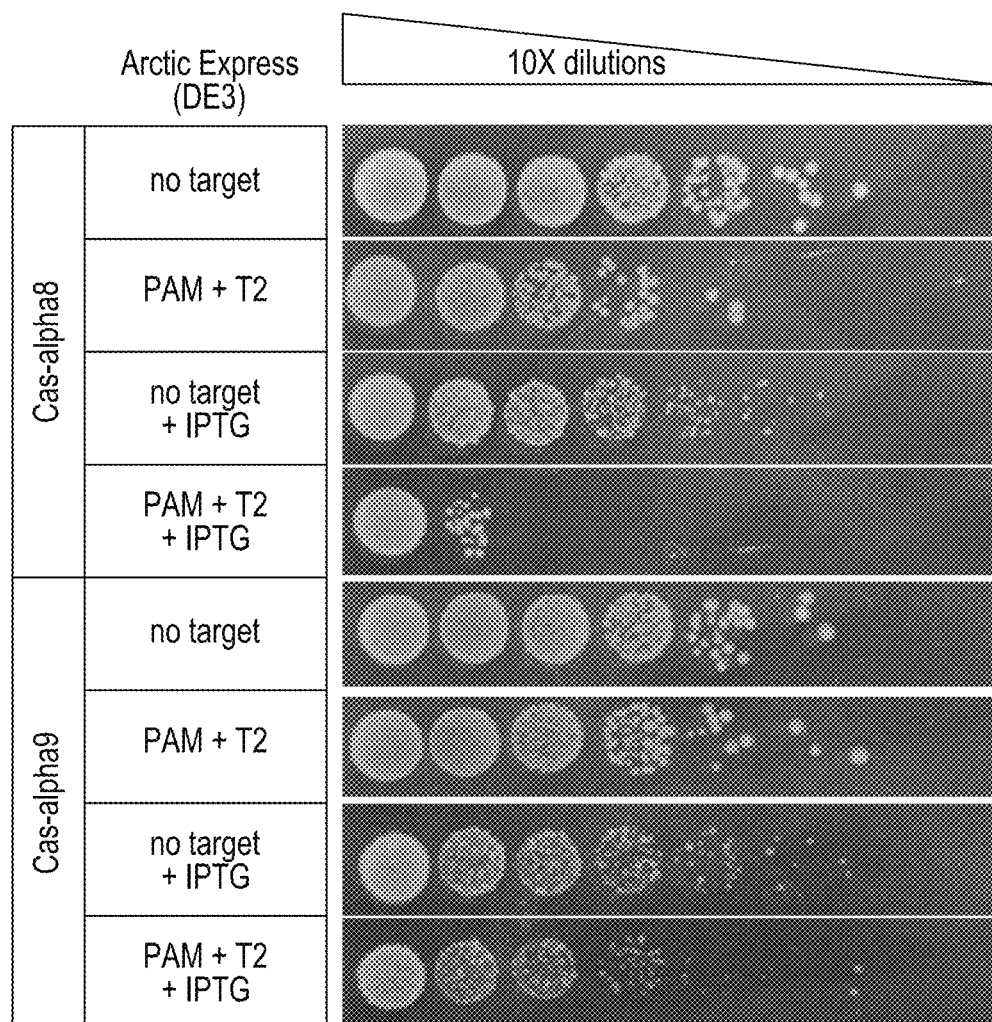
Figure 17E:
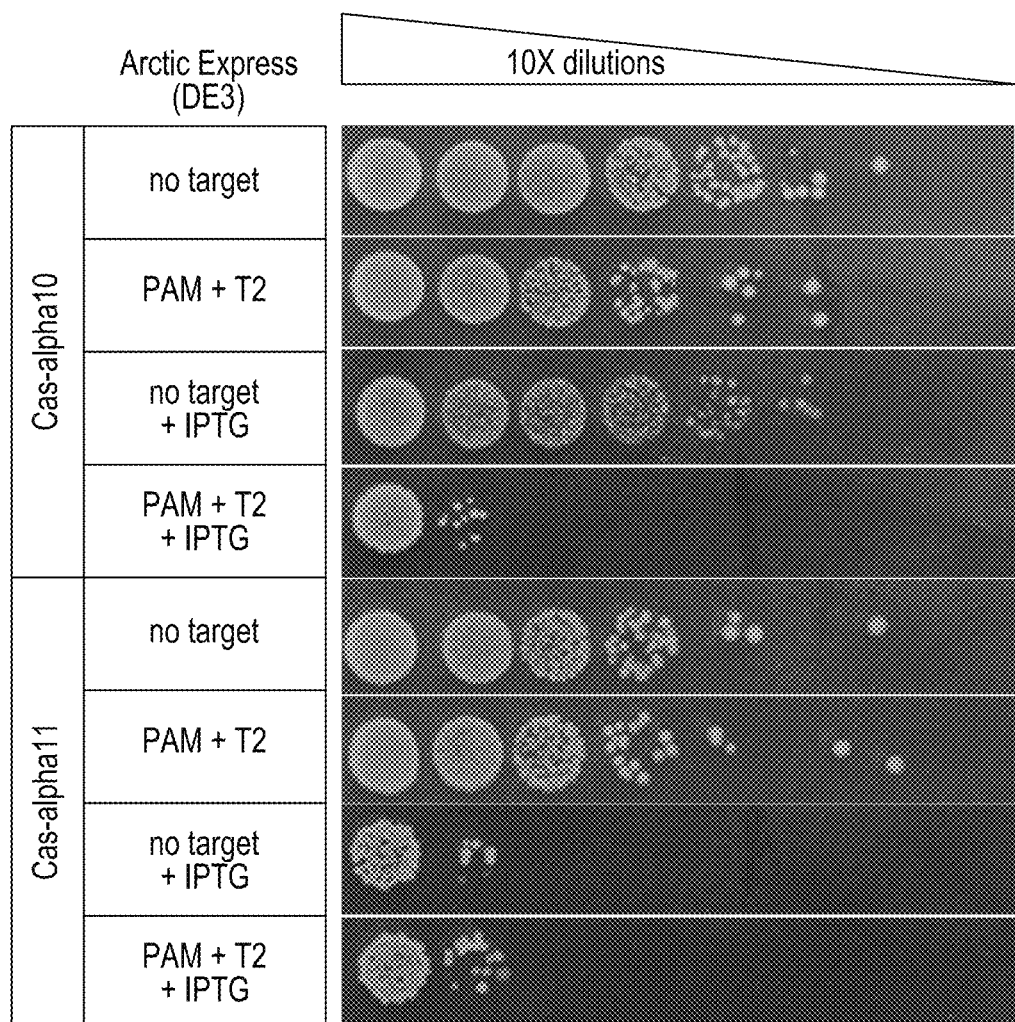

FIG. 17A depicts one method to assess Cas-alpha double stranded DNA target cleavage in *E. coli* cells. FIGS. 17B-17E show double stranded DNA target cleavage in *E. coli*. The "no target" experiments provide a baseline for transformation efficiency in the absence of double stranded DNA target cleavage. "Target" experiments, PAM+T2, were performed with and without IPTG (0.5 mM) to examine target cleavage under different Cas-alpha endonuclease and guide RNA expression conditions. FIG. 17B shows results for Cas-alpha 2 and Cas-alpha 3. FIG. 17C shows results for Cas-alpha 6 and Cas-alpha 7. FIG. 17D shows results for Cas-alpha 8 and Cas-alpha 9. FIG. 17E shows results for Cas-alpha 10 and Cas-alpha 11.

FIGS. 18A-18B depict double stranded break repair mutations in plant cells from Cas-alpha endonuclease activity, for particle gun experiments delivering Cas-alpha 10 DNA expression constructions into *Zea mays* immature embryos. FIG. 18A shows recovery of targeted deletions produced at or near the nuclease cut site for the nptII target site. FIG. 18B shows recovery of targeted deletions produced at or near the nuclease cut site for the ms26 target site.

Figure 19A:
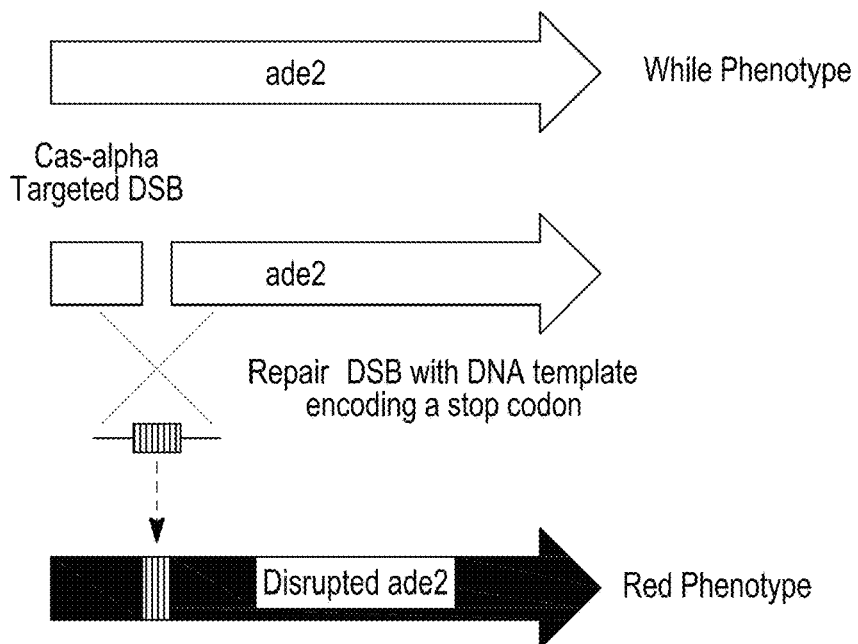
Figure 19B:
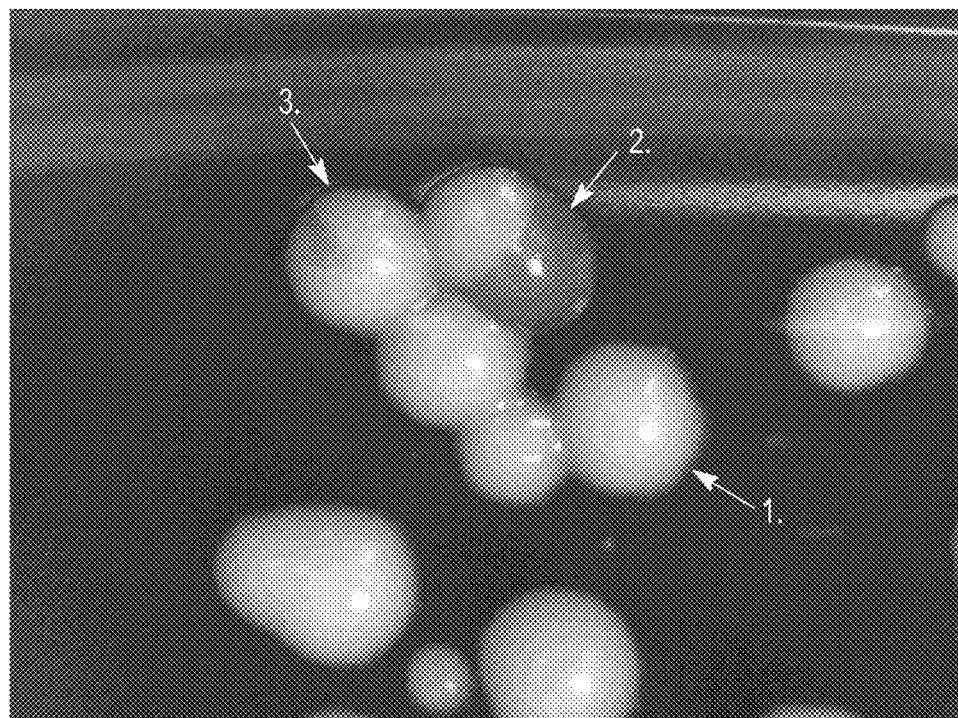
Figure 19C:
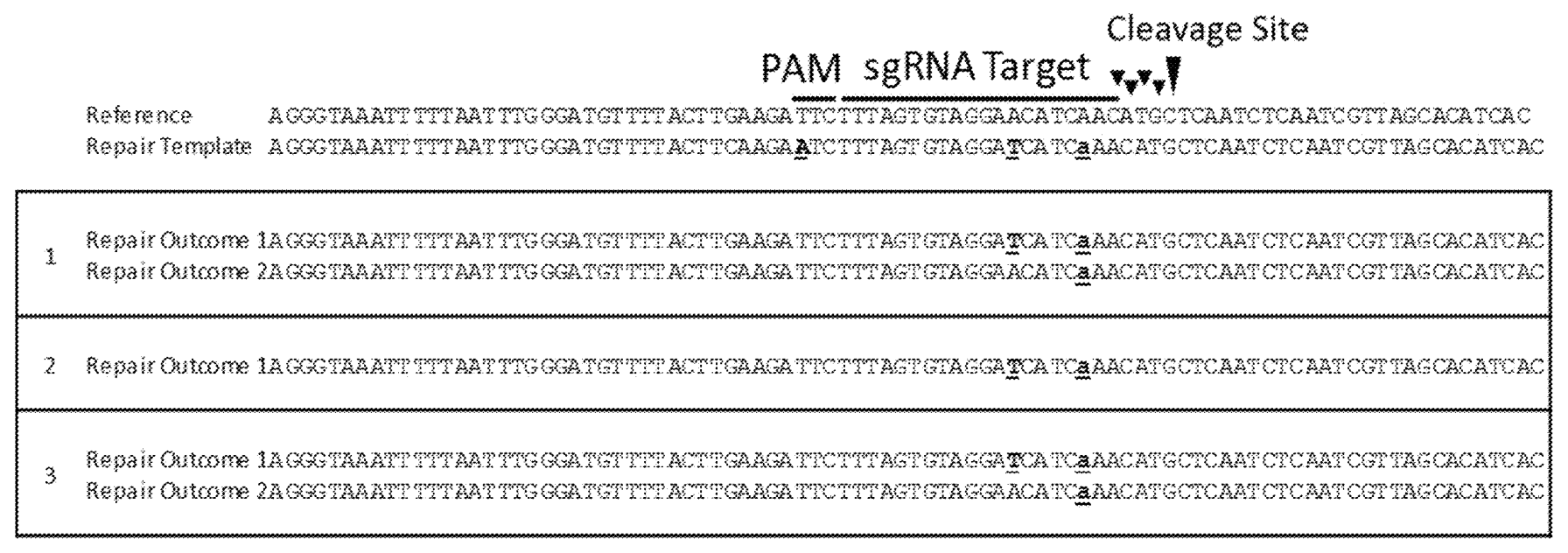

FIG. 19A depicts the experimental design for homology-directed repair in a eukaryotic cell, *Saccaromyces cerevisiae*. An exogenously supplied DNA repair template (double stranded) with homology flanking a Cas-alpha 10 target site was used to introduce one or two premature stop codons (depending on the DNA repair outcome) in the ade2 gene following a Cas-alpha 10 induced double strand break (DSB). To avoid targeting of the repair template, it also contained a T to A change in the PAM region for Cas-alpha 10. FIG. 19B shows that a red cellular phenotype indicative of ade2 gene disruption was recovered when both the repair template and Cas-alpha 10 and sgRNA expression constructs were transformed, and a double strand break was created by the Cas-alpha endonuclease and repaired with a template (HDR). FIG. 19C shows sequencing results of the Cas-alpha10 ade2 gene target site, confirming the introduction of at least one stop codon in 3 independent red colonies (labeled "1", "2" and "3"). Stop codons were introduced into the antisense frame. SEQ ID NO:170 The reference DNA sequence from *Saccharomyces cerevisiae* is given as SEQ ID NO:170, the repair template DNA is SEQ ID NO:171, Red Colony 1 repair outcome 1 is SEQ ID NO:172, Red Colony 1 repair outcome 2 is SEQ ID NO:173, Red Colony 2 repair outcome 1 is SEQ ID NO:174, Red Colony 3 repair outcome 1 is SEQ ID NO: 175, and Red Colony 3 repair outcome 2 is SEQ ID NO:176.

Figure 20:
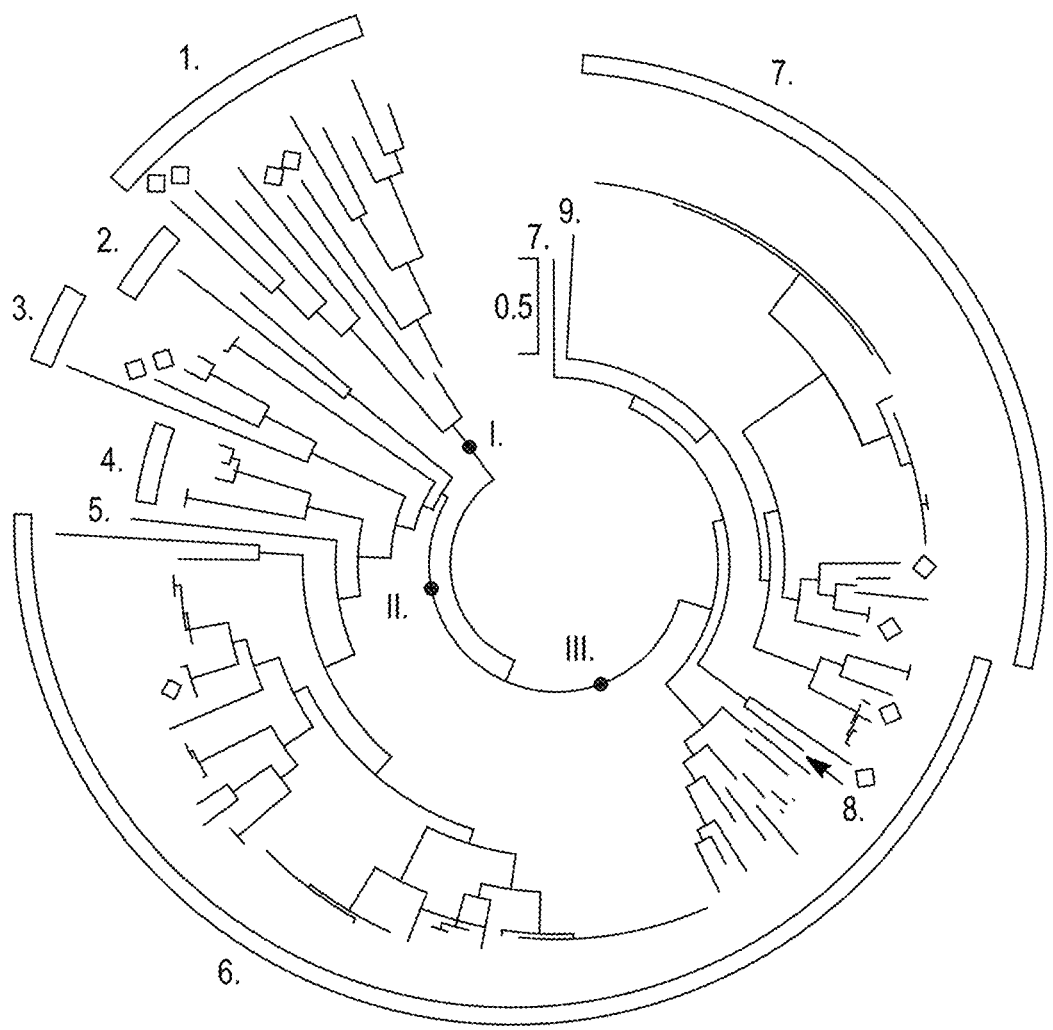

FIG. 20 shows the phylogenetic relationships among some of the Cas-alpha orthologs. Three supergroups were identified (I, II, and III). Group I comprised Clade 1 (*Candidate Archaea* and Aureabacteria (Cas1, Cas2, Cas4 typically encoded in the locus)). GroupII comprised Clade 2 (*Aquificae* (*Sulfurihydrogenibium* and *Hydrogenivirga* genera) and *Deltaproteobacteria* (*Desulfovibrio* genus)), Clade 3 (*Candidate Archaea* (Cas1, Cas2, and Cas4 typically encoded in the locus)), Clade 4 (*Bacteroidetes* (*Prevotella* and *Bacteroides* genera)), Clade 5 (*Candidate Levybacterium*), and Clade 6 (*Clostridia* (*Dorea, Ruminococcus, Clostridium, Clostridioides, Peptocolstridium, Cellulosilyticym, Eubacterium, Syntrophomonas* genera)). Group III comprised Clade 7 (*Bacilli* (*Bacillus, Acidibacillus, Aneurinibacillus, Brevibacillus, Parageobacillus, Alicyclobacillus* genera)), Clade 8 (*Negativicutes* (*Phascolarctobacterium* genus)), and Clade 9 (*Flavobacteriia* (*Flavobacterium* genus)). A diamond symbol represents the Cas-alphas 1-11 endonucleases described herein.

Figure 21A:
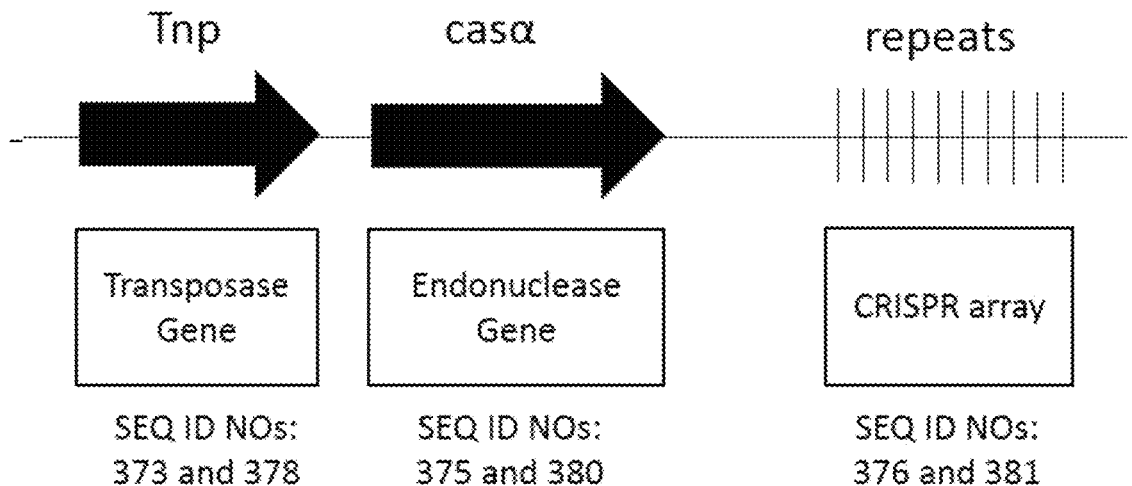
Figure 21B:
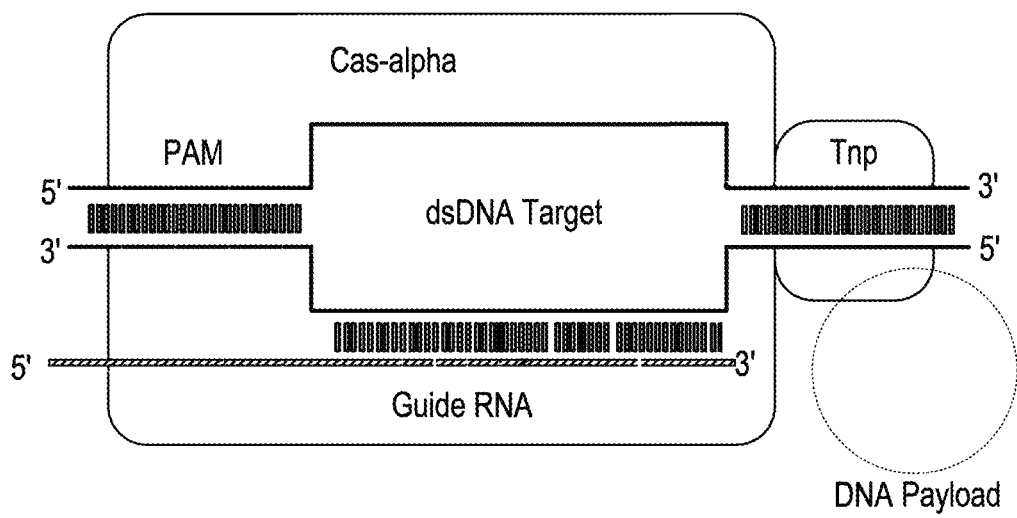

FIG. 21A illustrates a transposase (Tnp) associated Cas-alpha CRISPR system. In both instances, a Tnp-like protein is encoded upstream of a Cas-alpha endonuclease and CRISPR array. FIG. 21B shows a Cas-alpha endonuclease and guide RNA in complex with its target site and a Tnp-like protein that is posed to integrate a DNA Payload(circle with a dashed-line) within or near the Cas-alpha double stranded DNA target site.

The sequence descriptions and sequence listing attached hereto comply with the rules governing nucleotide and amino acid sequence disclosures in patent applications as set forth in 37 C.F.R. §§ 1.821 and 1.825. The sequence descriptions comprise the three letter codes for amino acids as defined in 37 C.F.R. §§ 1.821 and 1.825, which are incorporated herein by reference.

SEQ ID NO:1 is the Cas1 encoded in Cas-alpha 1 locus PRT sequence from *Candidatus Micrarchaeota* archaeon.

SEQ ID NO:2 is the Cas1 encoded in Cas-alpha 2 locus PRT sequence from *Candidatus Micrarchaeota* archaeon.

SEQ ID NO:3 is the Cas1 encoded in Cas-alpha 3 locus PRT sequence from *Candidatus Aureabacteria* bacterium.

SEQ ID NO:4 is the Cas1 encoded in Cas-alpha 4 locus PRT sequence from Uncultured archaeon.

SEQ ID NO:5 is the Cas2 encoded in Cas-alpha 1 locus PRT sequence from *Candidatus Micrarchaeota* archaeon.

SEQ ID NO:6 is the Cas2 encoded in Cas-alpha 2 locus PRT sequence from *Candidatus Micrarchaeota* archaeon.

SEQ ID NO:7 is the Cas2 encoded in Cas-alpha 3 locus PRT sequence from *Candidatus Aureabacteria* bacterium.

SEQ ID NO:8 is the Cas2 encoded in Cas-alpha 4 locus PRT sequence from Uncultured archaeon.

SEQ ID NO:9 is the Cas4 encoded in Cas-alpha 1 locus PRT sequence from *Candidatus Micrarchaeota* archaeon.

SEQ ID NO:10 is the Cas4 encoded in Cas-alpha 2 locus PRT sequence from *Candidatus Micrarchaeota* archaeon.

SEQ ID NO:11 is the Cas4 encoded in Cas-alpha 3 locus PRT sequence from *Candidatus Aureabacteria* bacterium.

SEQ ID NO:12 is the Cas4 encoded in Cas-alpha 4 locus PRT sequence from Uncultured archaeon.

SEQ ID NO:13 is the Cas-alpha 1 endonuclease gene DNA sequence from *Candidatus Micrarchaeota* archaeon.

SEQ ID NO:14 is the Cas-alpha 2 endonuclease gene DNA sequence from *Candidatus Micrarchaeota* archaeon.

SEQ ID NO:15 is the Cas-alpha 3 endonuclease gene DNA sequence from *Candidatus Aureabacteria* bacterium.

SEQ ID NO:16 is the Cas-alpha 4 endonuclease gene DNA sequence from Uncultured archaeon.

SEQ ID NO:17 is the Cas-alpha 1 endonuclease (Cas14b4) PRT sequence from *Candidatus Micrarchaeota* archaeon.

SEQ ID NO:18 is the Cas-alpha 2 endonuclease PRT sequence from *Candidatus Micrarchaeota* archaeon.

SEQ ID NO:19 is the Cas-alpha 3 endonuclease PRT sequence from *Candidatus Aureabacteria* bacterium.

SEQ ID NO:20 is the Cas-alpha 4 endonuclease (Cas14a1) PRT sequence from Uncultured archaeon.

SEQ ID NO:21 is the Cas-alpha 1 locus DNA sequence from *Candidatus Micrarchaeota* archaeon.

SEQ ID NO:22 is the Cas-alpha 2 locus DNA sequence from *Candidatus Micrarchaeota* archaeon.

SEQ ID NO:23 is the Cas-alpha 3 locus DNA sequence from *Candidatus Aureabacteria* bacterium.

SEQ ID NO:24 is the Cas-alpha 4 locus DNA sequence from Uncultured archaeon.

SEQ ID NO:25 is the Cas-alpha 5 endonuclease gene DNA sequence from *Candidatus Micrarchaeota* archaeon.

SEQ ID NO:26 is the Cas-alpha 6 endonuclease gene DNA sequence from Uncultured archaeon.

SEQ ID NO:27 is the Cas-alpha 7 endonuclease gene DNA sequence from *Parageobacillus thermoglucosidasius*.

SEQ ID NO:28 is the Cas-alpha 8 endonuclease gene DNA sequence from *Acidibacillus sulfuroxidans*.

SEQ ID NO:29 is the Cas-alpha 9 endonuclease gene DNA sequence from *Ruminococcus* sp.

SEQ ID NO:30 is the Cas-alpha 10 endonuclease gene DNA sequence from *Syntrophomonas palmitatica*.

SEQ ID NO:31 is the Cas-alpha 11 endonuclease gene DNA sequence from *Clostridium novyi*.

SEQ ID NO:32 is the Cas-alpha 5 endonuclease PRT sequence from *Candidatus Micrarchaeota* archaeon.

SEQ ID NO:33 is the Cas-alpha 6 endonuclease PRT sequence from Uncultured archaeon.

SEQ ID NO:34 is the Cas-alpha 7 endonuclease PRT sequence from *Parageobacillus thermoglucosidasius*.

SEQ ID NO:35 is the Cas-alpha 8 endonuclease PRT sequence from *Acidibacillus sulfuroxidans*.

SEQ ID NO:36 is the Cas-alpha 9 endonuclease PRT sequence from *Ruminococcus* sp.

SEQ ID NO:37 is the Cas-alpha 10 endonuclease PRT sequence from *Syntrophomonas palmitatica*.

SEQ ID NO:38 is the Cas-alpha 11 endonuclease PRT sequence from *Clostridium novyi*.

SEQ ID NO:39 is the Cas-alpha 5 locus DNA sequence from *Candidatus Micrarchaeota* archaeon.

SEQ ID NO:40 is the Cas-alpha 6 locus DNA sequence from Uncultured archaeon.

SEQ ID NO:41 is the Cas-alpha 7 locus DNA sequence from *Parageobacillus thermoglucosidasius*.

SEQ ID NO:42 is the Cas-alpha 8 locus DNA sequence from *Acidibacillus sulfuroxidans*.

SEQ ID NO:43 is the Cas-alpha 9 locus DNA sequence from *Ruminococcus* sp.

SEQ ID NO:44 is the Cas-alpha 10 locus DNA sequence from *Syntrophomonas palmitatica*.

SEQ ID NO:45 is the Cas-alpha 11 locus DNA sequence from *Clostridium novyi*.

SEQ ID NO:46 is the Cas-alpha 1 repeat consensus DNA sequence from *Candidatus Micrarchaeota* archaeon.

SEQ ID NO:47 is the Cas-alpha 2 repeat consensus DNA sequence from *Candidatus Micrarchaeota* archaeon.

SEQ ID NO:48 is the Cas-alpha 3 repeat consensus DNA sequence from *Candidatus Aureabacteria* bacterium.

SEQ ID NO:49 is the Cas-alpha 4 repeat consensus DNA sequence from Uncultured archaeon.

SEQ ID NO:50 is the Cas-alpha 5 repeat consensus DNA sequence from *Candidatus Micrarchaeota* archaeon.

SEQ ID NO:51 is the Cas-alpha 6 repeat consensus DNA sequence from Uncultured archaeon.
SEQ ID NO:52 is the Cas-alpha 7 repeat consensus DNA sequence from *Parageobacillus thermoglucosidasius*.
SEQ ID NO:53 is the Cas-alpha 8 repeat consensus DNA sequence from *Acidibacillus sulfuroxidans*.
SEQ ID NO:54 is the Cas-alpha 9 repeat consensus DNA sequence from *Ruminococcus* sp.
SEQ ID NO:55 is the Cas-alpha 10 repeat consensus DNA sequence from *Syntrophomonas palmitatica*.
SEQ ID NO:56 is the Cas-alpha 11 repeat consensus DNA sequence from *Clostridium novyi*.
SEQ ID NO:57 is the Cas-alpha 1 crRNA (where N represents any nucleotide) RNA sequence from Artificial.
SEQ ID NO:58 is the Cas-alpha 2 crRNA (where N represents any nucleotide) RNA sequence from Artificial.
SEQ ID NO:59 is the Cas-alpha 4 crRNA (where N represents any nucleotide) RNA sequence from Artificial.
SEQ ID NO:60 is the Cas-alpha 1 tracrRNA version 1 RNA sequence from *Candidatus Micrarchaeota* archaeon.
SEQ ID NO:61 is the Cas-alpha 1 tracrRNA version 2 RNA sequence from *Candidatus Micrarchaeota* archaeon.
SEQ ID NO:62 is the Cas-alpha 1 tracrRNA version 3 RNA sequence from *Candidatus Micrarchaeota* archaeon.
SEQ ID NO:63 is the Cas-alpha 1 tracrRNA version 4 RNA sequence from *Candidatus Micrarchaeota* archaeon.
SEQ ID NO:64 is the Cas-alpha 2 tracrRNA version 1 RNA sequence from *Candidatus Micrarchaeota* archaeon.
SEQ ID NO:65 is the Cas-alpha 2 tracrRNA version 2 RNA sequence from *Candidatus Micrarchaeota* archaeon.
SEQ ID NO:66 is the Cas-alpha 2 tracrRNA version 3 RNA sequence from *Candidatus Micrarchaeota* archaeon.
SEQ ID NO:67 is the Cas-alpha 2 tracrRNA version 4 RNA sequence from *Candidatus Micrarchaeota* archaeon.
SEQ ID NO:68 is the Cas-alpha 4 tracrRNA version 1 RNA sequence from Uncultured archaeon.
SEQ ID NO:69 is the Cas-alpha 1 sgRNA version 1 RNA sequence from Artificial.
SEQ ID NO:70 is the Cas-alpha 1 sgRNA version 2 RNA sequence from Artificial.
SEQ ID NO:71 is the Cas-alpha 1 sgRNA version 3 RNA sequence from Artificial.
SEQ ID NO:72 is the Cas-alpha 1 sgRNA version 4 RNA sequence from Artificial.
SEQ ID NO:73 is the Cas-alpha 2 sgRNA version 1 RNA sequence from Artificial.
SEQ ID NO:74 is the Cas-alpha 2 sgRNA version 2 RNA sequence from Artificial.
SEQ ID NO:75 is the Cas-alpha 2 sgRNA version 3 RNA sequence from Artificial.
SEQ ID NO:76 is the Cas-alpha 2 sgRNA version 4 RNA sequence from Artificial.
SEQ ID NO:77 is the Cas-alpha 4 sgRNA version 1 RNA sequence from Artificial.
SEQ ID NO:78 is the T2 spacer DNA sequence from Artificial.
SEQ ID NO:79 is the Complete Cas-alpha 1 locus engineered to target T2 DNA sequence from Artificial.
SEQ ID NO:80 is the Minimal Cas-alpha 1 locus engineered to target T2 DNA sequence from Artificial.
SEQ ID NO:81 is the 10× histidine tag PRT sequence from Artificial.
SEQ ID NO:82 is the 6× histidine tag PRT sequence from Artificial.
SEQ ID NO:83 is the Maltose binding protein tag PRT sequence from Artificial.
SEQ ID NO:84 is the Tobacco etch virus cleavage site PRT sequence from Tobacco etch virus.
SEQ ID NO:85 is the A1 oligonucleotide DNA sequence from Artificial.
SEQ ID NO:86 is the A2 oligonucleotide DNA sequence from Artificial.
SEQ ID NO:87 is the R0 oligonucleotide DNA sequence from Artificial.
SEQ ID NO:88 is the C0 oligonucleotide DNA sequence from Artificial.
SEQ ID NO:89 is the F1 oligonucleotide DNA sequence from Artificial.
SEQ ID NO:90 is the R1 oligonucleotide DNA sequence from Artificial.
SEQ ID NO:91 is the Bridge amplification portion of F1 oligonucleotide DNA sequence from Artificial.
SEQ ID NO:92 is the Bridge amplification portion of R1 oligonucleotide DNA sequence from Artificial.
SEQ ID NO:93 is the F2 oligonucleotide DNA sequence from Artificial.
SEQ ID NO:94 is the R2 oligonucleotide DNA sequence from Artificial.
SEQ ID NO:95 is the C1 oligonucleotide DNA sequence from Artificial.
SEQ ID NO:96 is the Sequence resulting from cleavage and adapter ligation at position 21 of the target DNA sequence from Artificial.
SEQ ID NO:97 is the Adapter portion of SEQ ID NO. 96 DNA sequence from Artificial.
SEQ ID NO:98 is the Target portion of SEQ ID NO. 96 DNA sequence from Artificial.
SEQ ID NO:99 is the Sequence 5' of PAM DNA sequence from Artificial.
SEQ ID NO:100 is the Fixed double stranded DNA target DNA sequence from Artificial.
SEQ ID NO:101 is the T2 target sequence DNA sequence from Artificial.
SEQ ID NO:102 is the Cas-alpha 4 T2-1 sgRNA RNA sequence from Artificial.
SEQ ID NO:103 is the Cas-alpha 4 T2-2 sgRNA RNA sequence from Artificial.
SEQ ID NO:104 is the Cas-alpha 4 T2-1 crRNA RNA sequence from Artificial.
SEQ ID NO:105 is the Cas-alpha 4 T2-2 crRNA RNA sequence from Artificial.
SEQ ID NO:106 is the ST-LS1 intron 2 DNA sequence from *Solanum tuberosum*.
SEQ ID NO:107 is the SV40 NLS PRT sequence from Simian virus 40.
SEQ ID NO:108 is the Nuc NLS PRT sequence from *Mus musculus*.
SEQ ID NO:109 is the Maize UBI promoter DNA sequence from *Zea mays*.
SEQ ID NO:110 is the Chicken beta-actin promoter DNA sequence from *Gallus gallus*.
SEQ ID NO:111 is the CMV enhancer DNA sequence from Human beta-herpesvirus 5.

SEQ ID NO:112 is the Maize UBI 5 prime untranslated region DNA sequence from *Zea mays*.
SEQ ID NO:113 is the Maize UBI intron 1 DNA sequence from *Zea mays*.
SEQ ID NO:114 is the Hybrid intron DNA sequence from Artificial.
SEQ ID NO:115 is the Maize U6 polymerase III promoter DNA sequence from *Zea mays*.
SEQ ID NO:116 is the Human U6 polymerase III promoter DNA sequence from *Homo sapiens*.
SEQ ID NO:117 is the Strep II tag PRT sequence from Artificial.
SEQ ID NO:118 is the bGH poly(A) terminator DNA sequence from *Bos taurus*.
SEQ ID NO:119 is the Potato Proteinase Inhibitor II (Pin II) terminator DNA sequence from *Solanum tuberosum*.
SEQ ID NO:120 is the *Zea mays* Wt Reference (Liguleless Targets 2 and 3) DNA sequence from *Zea mays*.
SEQ ID NO:121 is the Mutation 1 (Liguleless Targets 2 and 3-DNA Exp.) DNA sequence from *Zea mays*.
SEQ ID NO:122 is the Mutation 2 (Liguleless Targets 2 and 3-DNA Exp.) DNA sequence from *Zea mays*.
SEQ ID NO:123 is the Mutation 3 (Liguleless Targets 2 and 3-DNA Exp.) DNA sequence from *Zea mays*.
SEQ ID NO:124 is the Mutation 4 (Liguleless Targets 2 and 3-DNA Exp.) DNA sequence from *Zea mays*.
SEQ ID NO:125 is the Mutation 5 (Liguleless Targets 2 and 3-DNA Exp.) DNA sequence from *Zea mays*.
SEQ ID NO:126 is the HEK293 Wt Reference (VEGFA Target 2) DNA sequence from *Homo sapiens*.
SEQ ID NO:127 is the Mutation 1 (VEGFA Target 2-RNP) DNA sequence from *Homo sapiens*.
SEQ ID NO:128 is the Mutation 2 (VEGFA Target 2-RNP) DNA sequence from *Homo sapiens*.
SEQ ID NO:129 is the Mutation 3 (VEGFA Target 2-RNP) DNA sequence from *Homo sapiens*.
SEQ ID NO:130 is the Mutation 4 (VEGFA Target 2-RNP) DNA sequence from *Homo sapiens*.
SEQ ID NO:131 is the Mutation 5 (VEGFA Target 2-RNP) DNA sequence from *Homo sapiens*.
SEQ ID NO:132 is the HEK293 Wt Reference (VEGFA Target 3) DNA sequence from *Homo sapiens*.
SEQ ID NO:133 is the Mutation 1 (VEGFA Target 3-RNP) DNA sequence from *Homo sapiens*.
SEQ ID NO:134 is the Mutation 1 (VEGFA Target 3-DNA Exp) DNA sequence from *Homo sapiens*.
SEQ ID NO:135 is the Mutation 2 (VEGFA Target 3-DNA Exp) DNA sequence from *Homo sapiens*.
SEQ ID NO:136 is the ROX3 promoter DNA sequence from *Saccharomyces cerevisiae*.
SEQ ID NO:137 is the GAL promoter DNA sequence from *Saccharomyces cerevisiae*.
SEQ ID NO:138 is the HH Ribozyme (where N represents nucleotides that are complementary to the 6 nucleotides 3' of ribozyme) DNA sequence from Artificial.
SEQ ID NO:139 is the HDV Ribozyme DNA sequence from *Hepatitis delta* virus.
SEQ ID NO:140 is the SNR52 promoter DNA sequence from *Saccharomyces cerevisiae*.
SEQ ID NO:141 is the SUP4 terminator DNA sequence from *Saccharomyces cerevisiae*.
SEQ ID NO:142 is the FIG. 15C top sequence DNA sequence from Artificial.
SEQ ID NO:143 is the FIG. 15C bottom sequence DNA sequence from Artificial.
SEQ ID NO:144 is the FIG. 18A Reference DNA sequence from *Zea mays*.
SEQ ID NO:145 is the Mutation 1 DNA sequence from *Zea mays*.
SEQ ID NO:146 is the Mutation 2 DNA sequence from *Zea mays*.
SEQ ID NO:147 is the Mutation 3 DNA sequence from *Zea mays*.
SEQ ID NO:148 is the Mutation 4 DNA sequence from *Zea mays*.
SEQ ID NO:149 is the Mutation 5 DNA sequence from *Zea mays*.
SEQ ID NO:150 is the Mutation 6 DNA sequence from *Zea mays*.
SEQ ID NO:151 is the Mutation 7 DNA sequence from *Zea mays*.
SEQ ID NO:152 is the Mutation 8 DNA sequence from *Zea mays*.
SEQ ID NO:153 is the Mutation 9 DNA sequence from *Zea mays*.
SEQ ID NO:154 is the Mutation 10 DNA sequence from *Zea mays*.
SEQ ID NO:155 is the Mutation 11 DNA sequence from *Zea mays*.
SEQ ID NO:156 is the Mutation 12 DNA sequence from *Zea mays*.
SEQ ID NO:157 is the Mutation 13 DNA sequence from *Zea mays*.
SEQ ID NO:158 is the Mutation 14 DNA sequence from *Zea mays*.
SEQ ID NO:159 is the Mutation 15 DNA sequence from *Zea mays*.
SEQ ID NO:160 is the Mutation 16 DNA sequence from *Zea mays*.
SEQ ID NO:161 is the Mutation 17 DNA sequence from *Zea mays*.
SEQ ID NO:162 is the Mutation 18 DNA sequence from *Zea mays*.
SEQ ID NO:163 is the Mutation 19 DNA sequence from *Zea mays*.
SEQ ID NO:164 is the FIG. 18B Reference DNA sequence from *Zea mays*.
SEQ ID NO:165 is the Mutation 1 DNA sequence from *Zea mays*.
SEQ ID NO:166 is the Mutation 2 DNA sequence from *Zea mays*.
SEQ ID NO:167 is the Mutation 3 DNA sequence from *Zea mays*.
SEQ ID NO:168 is the Mutation 4 DNA sequence from *Zea mays*.
SEQ ID NO:169 is the Mutation 5 DNA sequence from *Zea mays*.
SEQ ID NO:170 is the FIG. 19C Reference DNA sequence from *Saccharomyces cerevisiae*.
SEQ ID NO:171 is the Repair template DNA sequence from Artificial.
SEQ ID NO:172 is the Repair outcome 1 DNA sequence from *Saccharomyces cerevisiae*.
SEQ ID NO:173 is the Repair outcome 2 DNA sequence from *Saccharomyces cerevisiae*.
SEQ ID NO:174 is the Repair outcome 1 DNA sequence from *Saccharomyces cerevisiae*.
SEQ ID NO:175 is the Repair outcome 1 DNA sequence from *Saccharomyces cerevisiae*.
SEQ ID NO:176 is the Repair outcome 2 DNA sequence from *Saccharomyces cerevisiae*.

SEQ ID NO:177 is the Cas-alpha 3 crRNA (where N represents any nucleotide) RNA sequence from Artificial.
SEQ ID NO:178 is the Cas-alpha 5 crRNA (where N represents any nucleotide) RNA sequence from Artificial.
SEQ ID NO:179 is the Cas-alpha 6 crRNA (where N represents any nucleotide) RNA sequence from Artificial.
SEQ ID NO:180 is the Cas-alpha 7 crRNA (where N represents any nucleotide) RNA sequence from Artificial.
SEQ ID NO:181 is the Cas-alpha 8 crRNA (where N represents any nucleotide) RNA sequence from Artificial.
SEQ ID NO:182 is the Cas-alpha 9 crRNA (where N represents any nucleotide) RNA sequence from Artificial.
SEQ ID NO:183 is the Cas-alpha 10 crRNA (where N represents any nucleotide) RNA sequence from Artificial.
SEQ ID NO:184 is the Cas-alpha 11 crRNA (where N represents any nucleotide) RNA sequence from Artificial.
SEQ ID NO:185 is the Cas-alpha 2 tracrRNA version 5 RNA sequence from *Candidatus Micrarchaeota archaeon*.
SEQ ID NO:186 is the Cas-alpha 2 tracrRNA version 6 RNA sequence from *Candidatus Micrarchaeota archaeon*.
SEQ ID NO:187 is the Cas-alpha 2 tracrRNA version 7 RNA sequence from *Candidatus Micrarchaeota archaeon*.
SEQ ID NO:188 is the Cas-alpha 6 tracrRNA version 1 RNA sequence from Uncultured archaeon.
SEQ ID NO:189 is the Cas-alpha 6 tracrRNA version 2 RNA sequence from Uncultured archaeon.
SEQ ID NO:190 is the Cas-alpha 6 tracrRNA version 3 RNA sequence from Uncultured archaeon.
SEQ ID NO:191 is the Cas-alpha 6 tracrRNA version 4 RNA sequence from Uncultured archaeon.
SEQ ID NO:192 is the Cas-alpha 7 tracrRNA version 1 RNA sequence from *Parageobacillus thermoglucosidasius*.
SEQ ID NO:193 is the Cas-alpha 7 tracrRNA version 2 RNA sequence from *Parageobacillus thermoglucosidasius*.
SEQ ID NO:194 is the Cas-alpha 8 tracrRNA version 1 RNA sequence from *Acidibacillus sulfuroxidans*.
SEQ ID NO:195 is the Cas-alpha 8 tracrRNA version 2 RNA sequence from *Acidibacillus sulfuroxidans*.
SEQ ID NO:196 is the Cas-alpha 8 tracrRNA version 3 RNA sequence from *Acidibacillus sulfuroxidans*.
SEQ ID NO:197 is the Cas-alpha 9 tracrRNA version 1 RNA sequence from *Ruminococcus* sp.
SEQ ID NO:198 is the Cas-alpha 9 tracrRNA version 2 RNA sequence from *Ruminococcus* sp.
SEQ ID NO:199 is the Cas-alpha 10 tracrRNA version 1 RNA sequence from *Syntrophomonas palmitatica*.
SEQ ID NO:200 is the Cas-alpha 10 tracrRNA version 2 RNA sequence from *Syntrophomonas palmitatica*.
SEQ ID NO:201 is the Cas-alpha 10 tracrRNA version 3 RNA sequence from *Syntrophomonas palmitatica*.
SEQ ID NO:202 is the Cas-alpha 10 tracrRNA version 4 RNA sequence from *Syntrophomonas palmitatica*.
SEQ ID NO:203 is the Cas-alpha 10 tracrRNA version 5 RNA sequence from *Syntrophomonas palmitatica*.
SEQ ID NO:204 is the Cas-alpha 11 tracrRNA version 1 RNA sequence from *Clostridium novyi*.
SEQ ID NO:205 is the Cas-alpha 11 tracrRNA version 2 RNA sequence from *Clostridium novyi*.
SEQ ID NO:206 is the Cas-alpha 11 tracrRNA version 3 RNA sequence from *Clostridium novyi*.
SEQ ID NO:207 is the Cas-alpha 11 tracrRNA version 4 RNA sequence from *Clostridium novyi*.
SEQ ID NO:208 is the Cas-alpha 2 sgRNA version 5 RNA sequence from Artificial.
SEQ ID NO:209 is the Cas-alpha 2 sgRNA version 6 RNA sequence from Artificial.
SEQ ID NO:210 is the Cas-alpha 2 sgRNA version 7 RNA sequence from Artificial.
SEQ ID NO:211 is the Cas-alpha 6 sgRNA version 1 RNA sequence from Artificial.
SEQ ID NO:212 is the Cas-alpha 6 sgRNA version 2 RNA sequence from Artificial.
SEQ ID NO:213 is the Cas-alpha 6 sgRNA version 3 RNA sequence from Artificial.
SEQ ID NO:214 is the Cas-alpha 6 sgRNA version 4 RNA sequence from Artificial.
SEQ ID NO:215 is the Cas-alpha 7 sgRNA version 1 RNA sequence from Artificial.
SEQ ID NO:216 is the Cas-alpha 7 sgRNA version 2 RNA sequence from Artificial.
SEQ ID NO:217 is the Cas-alpha 7 sgRNA version 3 RNA sequence from Artificial.
SEQ ID NO:218 is the Cas-alpha 8 sgRNA version 1 RNA sequence from Artificial.
SEQ ID NO:219 is the Cas-alpha 8 sgRNA version 2 RNA sequence from Artificial.
SEQ ID NO:220 is the Cas-alpha 8 sgRNA version 3 RNA sequence from Artificial.
SEQ ID NO:221 is the Cas-alpha 8 sgRNA version 4 RNA sequence from Artificial.
SEQ ID NO:222 is the Cas-alpha 9 sgRNA version 1 RNA sequence from Artificial.
SEQ ID NO:223 is the Cas-alpha 9 sgRNA version 2 RNA sequence from Artificial.
SEQ ID NO:224 is the Cas-alpha 9 sgRNA version 3 RNA sequence from Artificial.
SEQ ID NO:225 is the Cas-alpha 10 sgRNA version 1 RNA sequence from Artificial.
SEQ ID NO:226 is the Cas-alpha 10 sgRNA version 2 RNA sequence from Artificial.
SEQ ID NO:227 is the Cas-alpha 10 sgRNA version 3 RNA sequence from Artificial.
SEQ ID NO:228 is the Cas-alpha 10 sgRNA version 4 RNA sequence from Artificial.
SEQ ID NO:229 is the Cas-alpha 10 sgRNA version 5 RNA sequence from Artificial.
SEQ ID NO:230 is the Cas-alpha 11 sgRNA version 1 RNA sequence from Artificial.
SEQ ID NO:231 is the Cas-alpha 11 sgRNA version 2 RNA sequence from Artificial.
SEQ ID NO:232 is the Cas-alpha 11 sgRNA version 3 RNA sequence from Artificial.
SEQ ID NO:233 is the Cas-alpha 11 sgRNA version 4 RNA sequence from Artificial.
SEQ ID NO:234 is the Cas-alpha 11 sgRNA version 5 RNA sequence from Artificial.
SEQ ID NO:235 is the Cas-alpha 4 *Zea mays* codon optimized gene DNA sequence from Artificial.
SEQ ID NO:236 is the Cas-alpha 10 *Zea mays* codon optimized gene DNA sequence from Artificial.

SEQ ID NO:237 is the Cas-alpha 10 *Saccharomyces cerevisiae* codon optimized gene DNA sequence from Artificial.
SEQ ID NO:238 is the Cas-alpha 4 sgRNA backbone RNA sequence from Artificial.
SEQ ID NO:239 is the Cas-alpha 10 sgRNA backbone RNA sequence from Artificial.
SEQ ID NO:240 is the Cas-alpha 4 Liguleless 2 sgRNA Target Sequence RNA sequence from Artificial.
SEQ ID NO:241 is the Cas-alpha 4 Liguleless 3 sgRNA Target Sequence RNA sequence from Artificial.
SEQ ID NO:242 is the Cas-alpha 10 nptII sgRNA Target Sequence RNA sequence from Artificial.
SEQ ID NO:243 is the Cas-alpha 10 ms26 sgRNA Target Sequence RNA sequence from Artificial.
SEQ ID NO:244 is the Cas-alpha 10 ade2 sgRNA Target Sequence RNA sequence from Artificial.
SEQ ID NO:245 is the Cas-alpha 4 VEGFA 2 sgRNA Target Sequence RNA sequence from Artificial.
SEQ ID NO:246 is the Cas-alpha 4 VEGFA 3 sgRNA Target Sequence RNA sequence from Artificial.
SEQ ID NO:247 is the Cas-alpha 4 sgRNA Targeting Liguleless 2 RNA sequence from Artificial.
SEQ ID NO:248 is the Cas-alpha 4 sgRNA Targeting Liguleless 3 RNA sequence from Artificial.
SEQ ID NO:249 is the Cas-alpha 10 sgRNA Targeting nptII RNA sequence from Artificial.
SEQ ID NO:250 is the Cas-alpha 10 sgRNA Targeting ms26 RNA sequence from Artificial.
SEQ ID NO:251 is the Cas-alpha 10 sgRNA Targeting ade2 RNA sequence from Artificial.
SEQ ID NO:252 is the Cas-alpha 4 sgRNA Targeting VEGFA 2 RNA sequence from Artificial.
SEQ ID NO:253 is the Cas-alpha 4 sgRNA Targeting VEGFA 3 RNA sequence from Artificial.
SEQ ID NO:254 is the Cas-alpha 12 endonuclease PRT sequence from *Clostridioides difficile.*
SEQ ID NO:255 is the Cas-alpha 13 endonuclease PRT sequence from *Clostridium paraputrificum.*
SEQ ID NO:256 is the Cas-alpha 14 endonuclease PRT sequence from *Clostridium novyi.*
SEQ ID NO:257 is the Cas-alpha 15 endonuclease PRT sequence from *Ruminococcus albus.*
SEQ ID NO:258 is the Cas-alpha 16 endonuclease PRT sequence from *Clostridium hiranonis.*
SEQ ID NO:259 is the Cas-alpha 17 endonuclease PRT sequence from *Clostridium ihumii.*
SEQ ID NO:260 is the Cas-alpha 18 endonuclease PRT sequence from *Cellulosilyticum ruminicola.*
SEQ ID NO:261 is the Cas-alpha 19 endonuclease PRT sequence from *Eubacterium siraeum.*
SEQ ID NO:262 is the Cas-alpha 20 endonuclease PRT sequence from *Clostridium botulinum.*
SEQ ID NO:263 is the Cas-alpha 21 endonuclease PRT sequence from *Clostridium botulinum.*
SEQ ID NO:264 is the Cas-alpha 22 endonuclease PRT sequence from *Ruminiclostridium hungatei.*

SEQ ID NO:265 is the Cas-alpha 23 endonuclease PRT sequence from *Desulfovibrio fructosivorans.*

SEQ ID NO:266 is the Cas-alpha 24 endonuclease PRT sequence from *Bacillus toyonensis.*

SEQ ID NO:267 is the Cas-alpha 25 endonuclease PRT sequence from *Clostridium paraputrificum.*

SEQ ID NO:268 is the Cas-alpha 26 endonuclease PRT sequence from *Clostridium ventriculi.*

SEQ ID NO:269 is the Cas-alpha 27 endonuclease PRT sequence from *Ruminococcus* sp.

SEQ ID NO:270 is the Cas-alpha 28 endonuclease PRT sequence from *Ruminococcus* sp.

SEQ ID NO:271 is the Cas-alpha 29 endonuclease PRT sequence from *Peptoclostridium* sp.

SEQ ID NO:272 is the Cas-alpha 30 endonuclease PRT sequence from *Bacillus* sp.

SEQ ID NO:273 is the Cas-alpha 31 endonuclease PRT sequence from *Clostridioides difficile.*

SEQ ID NO:274 is the Cas-alpha 32 endonuclease PRT sequence from *Clostridioides difficile.*

SEQ ID NO:275 is the Cas-alpha 33 endonuclease PRT sequence from uncultured archaeon.

SEQ ID NO:276 is the Cas-alpha 34 endonuclease PRT sequence from uncultured archaeon.

SEQ ID NO:277 is the Cas-alpha 35 endonuclease PRT sequence from uncultured archaeon.

SEQ ID NO:278 is the Cas-alpha 36 endonuclease PRT sequence from uncultured archaeon.

SEQ ID NO:279 is the Cas-alpha 37 endonuclease PRT sequence from uncultured archaeon.

SEQ ID NO:280 is the Cas-alpha 38 endonuclease PRT sequence from uncultured archaeon.

SEQ ID NO:281 is the Cas-alpha 39 endonuclease PRT sequence from uncultured archaeon.

SEQ ID NO:282 is the Cas-alpha 40 endonuclease PRT sequence from uncultured archaeon.

SEQ ID NO:283 is the Cas-alpha 41 endonuclease PRT sequence from uncultured archaeon.

SEQ ID NO:284 is the Cas-alpha 42 endonuclease PRT sequence from Clostridioides *difficile.*

SEQ ID NO:285 is the Cas-alpha 43 endonuclease PRT sequence from *Desulfovibrio fructosivorans.*

SEQ ID NO:286 is the Cas-alpha 44 endonuclease PRT sequence from *Clostridium botulinum.*

SEQ ID NO:287 is the Cas-alpha 45 endonuclease PRT sequence from *Clostridioides difficile.*

SEQ ID NO:288 is the Cas-alpha 46 endonuclease PRT sequence from *Clostridioides difficile.*

SEQ ID NO:289 is the Cas-alpha 47 endonuclease PRT sequence from *Clostridioides difficile.*

SEQ ID NO:290 is the Cas-alpha 48 endonuclease PRT sequence from *Clostridioides difficile.*

SEQ ID NO:291 is the Cas-alpha 49 endonuclease PRT sequence from *Clostridioides difficile.*

SEQ ID NO:292 is the Cas-alpha 50 endonuclease PRT sequence from *Clostridioides difficile.*

SEQ ID NO:293 is the Cas-alpha 51 endonuclease PRT sequence from *Clostridioides difficile.*

SEQ ID NO:294 is the Cas-alpha 52 endonuclease PRT sequence from *Clostridioides difficile.*

SEQ ID NO:295 is the Cas-alpha 53 endonuclease PRT sequence from *Clostridioides difficile.*

SEQ ID NO:296 is the Cas-alpha 54 endonuclease PRT sequence from *Clostridioides difficile.*

SEQ ID NO:297 is the Cas-alpha 55 endonuclease PRT sequence from *Clostridium hiranonis.*

SEQ ID NO:298 is the Cas-alpha 56 endonuclease PRT sequence from *Clostridioides difficile*

SEQ ID NO:299 is the Cas-alpha 57 endonuclease PRT sequence from *Aneurinibacillus danicus.*

SEQ ID NO:300 is the Cas-alpha 58 endonuclease PRT sequence from *Parageobacillus thermoglucosidasius.*

SEQ ID NO:301 is the Cas-alpha 59 endonuclease PRT sequence from *Brevibacillus centrosporus.*

SEQ ID NO:302 is the Cas-alpha 60 endonuclease PRT sequence from *Clostridium pasteurianum.*

SEQ ID NO:303 is the Cas-alpha 61 endonuclease PRT sequence from *Eubacterium siraeum.*
SEQ ID NO:304 is the Cas-alpha 62 endonuclease PRT sequence from *Bacillus toyonensis.*

SEQ ID NO:305 is the Cas-alpha 63 endonuclease PRT sequence from *Ruminococcus* sp.

SEQ ID NO:306 is the Cas-alpha 64 endonuclease PRT sequence from *Ruminococcus* sp.

SEQ ID NO:307 is the Cas-alpha 65 endonuclease PRT sequence from *Clostridium perfringens.*

SEQ ID NO:308 is the Cas-alpha 66 endonuclease PRT sequence from *Bacillus thuringiensis.*

SEQ ID NO:309 is the Cas-alpha 67 endonuclease PRT sequence from *Clostridium perfringens.*

SEQ ID NO:310 is the Cas-alpha 68 endonuclease PRT sequence from *Bacillus cereus.*

SEQ ID NO:311 is the Cas-alpha 69 endonuclease PRT sequence from *Bacillus toyonensis.*

SEQ ID NO:312 is the Cas-alpha 70 endonuclease PRT sequence from *Bacillus toyonensis.*

SEQ ID NO:313 is the Cas-alpha 71 endonuclease PRT sequence from *Bacillus toyonensis.*

SEQ ID NO:314 is the Cas-alpha 72 endonuclease PRT sequence from *Alicyclobacillus acidoterrestris.*

SEQ ID NO:315 is the Cas-alpha 73 endonuclease PRT sequence from *Clostridium tetani.*

SEQ ID NO:316 is the Cas-alpha 74 endonuclease PRT sequence from *Candidatus Levybacteria* bacterium.

SEQ ID NO:317 is the Cas-alpha 75 endonuclease PRT sequence from *Bacillus cereus.*

SEQ ID NO:318 is the Cas-alpha 76 endonuclease PRT sequence from *Bacillus cereus.*

SEQ ID NO:319 is the Cas-alpha 77 endonuclease PRT sequence from *Bacillus cereus.*

SEQ ID NO:320 is the Cas-alpha 78 endonuclease PRT sequence from *Clostridium paraputrificum.*

SEQ ID NO:321 is the Cas-alpha 79 endonuclease PRT sequence from *Bacillus cereus.*

SEQ ID NO:322 is the Cas-alpha 80 endonuclease PRT sequence from *Bacillus thuringiensis.*

SEQ ID NO:323 is the Cas-alpha 81 endonuclease PRT sequence from *Bacillus cereus.*

SEQ ID NO:324 is the Cas-alpha 82 endonuclease PRT sequence from *Bacillus* toyonensis.

SEQ ID NO:325 is the Cas-alpha 83 endonuclease PRT sequence from *Bacillus cereus.*

SEQ ID NO:326 is the Cas-alpha 84 endonuclease PRT sequence from *Bacillus toyonensis.*

SEQ ID NO:327 is the Cas-alpha 85 endonuclease PRT sequence from *Bacillus wiedmannii.*

SEQ ID NO:328 is the Cas-alpha 86 endonuclease PRT sequence from *Bacillus cereus.*

SEQ ID NO:329 is the Cas-alpha 87 endonuclease PRT sequence from *Bacillus cereus.*

SEQ ID NO:330 is the Cas-alpha 88 endonuclease PRT sequence from *Bacillus toyonensis.*

SEQ ID NO:331 is the Cas-alpha 89 endonuclease PRT sequence from *Bacillus cereus.*

SEQ ID NO:332 is the Cas-alpha 90 endonuclease PRT sequence from *Bacillus toyonensis.*

SEQ ID NO:333 is the Cas-alpha 91 endonuclease PRT sequence from *Bacillus thuringiensis.*

SEQ ID NO:334 is the Cas-alpha 92 endonuclease PRT sequence from *Bacillus cereus.*

SEQ ID NO:335 is the Cas-alpha 93 endonuclease PRT sequence from *Bacillus cereus.*

SEQ ID NO:336 is the Cas-alpha 94 endonuclease PRT sequence from *Bacillus cereus.*

SEQ ID NO:337 is the Cas-alpha 95 endonuclease PRT sequence from *Bacillus thuringiensis.*

SEQ ID NO:338 is the Cas-alpha 96 endonuclease PRT sequence from *Bacillus* sp.

SEQ ID NO:339 is the Cas-alpha 97 endonuclease PRT sequence from *Bacillus cereus.*

SEQ ID NO:340 is the Cas-alpha 98 endonuclease PRT sequence from *Bacillus cereus.*

SEQ ID NO:341 is the Cas-alpha 99 endonuclease PRT sequence from *Bacillus thuringiensis.*

SEQ ID NO:342 is the Cas-alpha 100 endonuclease PRT sequence from *Bacillus* sp.

SEQ ID NO:343 is the Cas-alpha 101 endonuclease PRT sequence from *Prevotella copri.*

SEQ ID NO:344 is the Cas-alpha 102 endonuclease PRT sequence from *Prevotella copri.*

SEQ ID NO:345 is the Cas-alpha 103 endonuclease PRT sequence from *Clostridioides difficile.*

SEQ ID NO:346 is the Cas-alpha 104 endonuclease PRT sequence from *Clostridioides difficile.*

SEQ ID NO:347 is the Cas-alpha 105 endonuclease PRT sequence from *Clostridioides difficile.*

SEQ ID NO:348 is the Cas-alpha 106 endonuclease PRT sequence from *Clostridioides difficile.*

SEQ ID NO:349 is the Cas-alpha 107 endonuclease PRT sequence from *Clostridioides difficile.*

SEQ ID NO:350 is the Cas-alpha 108 endonuclease PRT sequence from *Clostridioides difficile.*

SEQ ID NO:351 is the Cas-alpha 109 endonuclease PRT sequence from *Clostridioides difficile.*

SEQ ID NO:352 is the Cas-alpha 110 endonuclease PRT sequence from *Flavobacterium thermophilum.*

SEQ ID NO:353 is the Cas-alpha 111 endonuclease PRT sequence from Phascolarctobacterium sp.

SEQ ID NO:354 is the Cas-alpha 112 endonuclease PRT sequence from *Bacillus pseudomycoides.*

SEQ ID NO:355 is the Cas-alpha 113 endonuclease PRT sequence from *Bacteroides* plebeius.

SEQ ID NO:356 is the Cas-alpha 114 endonuclease PRT sequence from *Clostridium botulinum.*

SEQ ID NO:357 is the Cas-alpha 115 endonuclease PRT sequence from *Bacillus pseudomycoides.*

SEQ ID NO:358 is the Cas-alpha 116 endonuclease PRT sequence from *Bacillus pseudomycoides.*

SEQ ID NO:359 is the Cas-alpha 117 endonuclease PRT sequence from *Clostridium botulinum.*

SEQ ID NO:360 is the Cas-alpha 118 endonuclease PRT sequence from *Clostridium botulinum.*

SEQ ID NO:361 is the Cas-alpha 119 endonuclease PRT sequence from *Clostridium botulinum.*

SEQ ID NO:362 is the Cas-alpha 120 endonuclease PRT sequence from *Hydrogenivirga* sp.

SEQ ID NO:363 is the Cas-alpha 121 endonuclease PRT sequence from *Bacillus megaterium.*

SEQ ID NO:364 is the Cas-alpha 122 endonuclease PRT sequence from *Clostridium fallax.*

SEQ ID NO:365 is the Cas-alpha 123 endonuclease PRT sequence from *Bacteroides plebeius.*

SEQ ID NO:366 is the Cas-alpha 124 endonuclease PRT sequence from *Bacillus thuringiensis.*

SEQ ID NO:367 is the Cas-alpha 125 endonuclease PRT sequence from *Bacillus cereus.*

SEQ ID NO:368 is the Cas-alpha 126 endonuclease PRT sequence from *Clostridium* sp.

SEQ ID NO:369 is the Cas-alpha 127 endonuclease PRT sequence from *Bacteroides* plebeius.

SEQ ID NO:370 is the Cas-alpha 128 endonuclease PRT sequence from *Dorea longicatena*.

SEQ ID NO:371 is the Cas-alpha 129 endonuclease PRT sequence from *Sulfurihydrogenibium azorense*.

DETAILED DESCRIPTION

Compositions and methods are provided for novel CRISPR effector systems and elements comprising such systems, including, but not limiting to, novel guide polynucleotide/endonuclease complexes, guide polynucleotides, guide RNA elements, Cas proteins, and endonucleases, as well as proteins comprising an endonuclease functionality (domain). Compositions and methods are also provided for direct delivery of endonucleases, cleavage ready complexes, guide RNAs, and guide RNA/Cas endonuclease complexes. The present disclosure further includes compositions and methods for genome modification of a target sequence in the genome of a cell, for gene editing, and for inserting a polynucleotide of interest into the genome of a cell.

Terms used in the claims and specification are defined as set forth below unless otherwise specified. It must be noted that, as used in the specification and the appended claims, the singular forms "a," "an" and "the" include plural referents unless the context clearly dictates otherwise.

Definitions

As used herein, "nucleic acid" means a polynucleotide and includes a single or a double-stranded polymer of deoxyribonucleotide or ribonucleotide bases. Nucleic acids may also include fragments and modified nucleotides. Thus, the terms "polynucleotide", "nucleic acid sequence", "nucleotide sequence" and "nucleic acid fragment" are used interchangeably to denote a polymer of RNA and/or DNA and/or RNA-DNA that is single- or double-stranded, optionally comprising synthetic, non-natural, or altered nucleotide bases. Nucleotides (usually found in their 5'-monophosphate form) are referred to by their single letter designation as follows:"A" for adenosine or deoxyadenosine (for RNA or DNA, respectively), "C" for cytosine or deoxycytosine, "G" for guanosine or deoxyguanosine, "U" for uridine, "T" for deoxythymidine, "R" for purines (A or G), "Y" for pyrimidines (C or T), "K" for G or T, "H" for A or C or T, "I" for inosine, and "N" for any nucleotide.

The term "genome" as it applies to a prokaryotic and eukaryotic cell or organism cells encompasses not only chromosomal DNA found within the nucleus, but organelle DNA found within subcellular components (e.g., mitochondria, or plastid) of the cell.

"Open reading frame" is abbreviated ORF.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence in an in vitro hybridization assay. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length. Typically, stringent conditions will be those in which the salt concentration is less than about 1.5 M Na ion, typically about 0.01 to 1.0 M Na ion concentration (or other salt(s)) at pH 7.0 to 8.3, and at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

By "homology" is meant DNA sequences that are similar. For example, a "region of homology to a genomic region" that is found on the donor DNA is a region of DNA that has a similar sequence to a given "genomic region" in the cell or organism genome. A region of homology can be of any length that is sufficient to promote homologous recombination at the cleaved target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800, 5-2900, 5-3000, 5-3100 or more bases in length such that the region of homology has sufficient homology to undergo homologous recombination with the corresponding genomic region. "Sufficient homology" indicates that two polynucleotide sequences have sufficient structural similarity to act as substrates for a homologous recombination reaction. The structural similarity includes overall length of each polynucleotide fragment, as well as the sequence similarity of the polynucleotides. Sequence similarity can be described by the percent sequence identity over the whole length of the sequences, and/or by conserved regions comprising localized similarities such as contiguous nucleotides having 100% sequence identity, and percent sequence identity over a portion of the length of the sequences.

As used herein, a "genomic region" is a segment of a chromosome in the genome of a cell that is present on either side of the target site or, alternatively, also comprises a portion of the target site. The genomic region can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases such that the genomic region has sufficient homology to undergo homologous recombination with the corresponding region of homology.

As used herein, "homologous recombination" (HR) includes the exchange of DNA fragments between two DNA molecules at the sites of homology. The frequency of homologous recombination is influenced by a number of factors. Different organisms vary with respect to the amount of homologous recombination and the relative proportion of homologous to non-homologous recombination. Generally, the length of the region of homology affects the frequency of homologous recombination events: the longer the region of homology, the greater the frequency. The length of the homology region needed to observe homologous recombination is also species-variable. In many cases, at least 5 kb of homology has been utilized, but homologous recombination has been observed with as little as 25-50 bp of homology. See, for example, Singer et al., (1982) Cell 31:25-33; Shen and Huang, (1986) Genetics 112:441-57; Watt et al., (1985) Proc. Natl. Acad. Sci. USA 82:4768-72, Sugawara and Haber, (1992) Mol Cell Biol 12:563-75, Rubnitz and Subramani, (1984) Mol Cell Biol 4:2253-8; Ayares et al., (1986) Proc. Natl. Acad. Sci. USA 83:5199-203; Liskay et al., (1987) Genetics 115:161-7.

"Sequence identity" or "identity" in the context of nucleic acid or polypeptide sequences refers to the nucleic acid bases or amino acid residues in two sequences that are the same when aligned for maximum correspondence over a specified comparison window.

The term "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, (1989) CABIOS 5:151-153; Higgins et al., (1992) Comput Appl Biosci 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=S and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" Table in the same program. The "Clustal W method of alignment" corresponds to the alignment method labeled Clustal W (described by Higgins and Sharp, (1989) CABIOS 5:151-153; Higgins et al., (1992) Comput Appl Biosci 8:189-191) and found in the MegAlign™ v6.1 program of the LASERGENE bioinformatics computing suite (DNASTAR Inc., Madison, Wis.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" Table in the same program. Unless otherwise stated, sequence identity/similarity values provided herein refer to the value obtained using GAP Version 10 (GCG, Accelrys, San Diego, Calif.) using the following parameters: % identity and % similarity for a nucleotide sequence using a gap creation penalty weight of 50 and a gap length extension penalty weight of 3, and the nwsgapdna.cmp scoring matrix; % identity and % similarity for an amino acid sequence using a GAP creation penalty weight of 8 and a gap length extension penalty of 2, and the BLOSUM62 scoring matrix (Henikoff and Henikoff, (1989) Proc. Natl. Acad. Sci. USA 89:10915). GAP uses the algorithm of Needleman and Wunsch, (1970) J Mol Biol 48:443-53, to find an alignment of two complete sequences that maximizes the number of matches and minimizes the number of gaps. GAP considers all possible alignments and gap positions and creates the alignment with the largest number of matched bases and the fewest gaps, using a gap creation penalty and a gap extension penalty in units of matched bases. "BLAST" is a searching algorithm provided by the National Center for Biotechnology Information (NCBI) used to find regions of similarity between biological sequences. The program compares nucleotide or protein sequences to sequence databases and calculates the statistical significance of matches to identify sequences having sufficient similarity to a query sequence such that the similarity would not be predicted to have occurred randomly. BLAST reports the identified sequences and their local alignment to the query sequence. It is well understood by one skilled in the art that many levels of sequence identity are useful in identifying polypeptides from other species or modified naturally or synthetically wherein such polypeptides have the same or similar function or activity. Useful examples of percent identities include, but are not limited to, 50%, 55%, 60%, 65%, 70%, 75%, 80%, 85%, 90% or 95%, or any percentage from 50% to 100%. Indeed, any amino acid identity from 50% to 100% may be useful in describing the present disclosure, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

Polynucleotide and polypeptide sequences, variants thereof, and the structural relationships of these sequences can be described by the terms "homology", "homologous", "substantially identical", "substantially similar" and "corresponding substantially" which are used interchangeably herein. These refer to polypeptide or nucleic acid sequences wherein changes in one or more amino acids or nucleotide bases do not affect the function of the molecule, such as the ability to mediate gene expression or to produce a certain phenotype. These terms also refer to modification(s) of nucleic acid sequences that do not substantially alter the functional properties of the resulting nucleic acid relative to the initial, unmodified nucleic acid. These modifications include deletion, substitution, and/or insertion of one or more nucleotides in the nucleic acid fragment. Substantially similar nucleic acid sequences encompassed may be defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

A "centimorgan" (cM) or "map unit" is the distance between two polynucleotide sequences, linked genes, markers, target sites, loci, or any pair thereof, wherein 1% of the products of meiosis are recombinant. Thus, a centimorgan is equivalent to a distance equal to a 1% average recombination frequency between the two linked genes, markers, target sites, loci, or any pair thereof.

An "isolated" or "purified" nucleic acid molecule, polynucleotide, polypeptide, or protein, or biologically active portion thereof, is substantially or essentially free from components that normally accompany or interact with the polynucleotide or protein as found in its naturally occurring environment. Thus, an isolated or purified polynucleotide or polypeptide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. Isolated polynucleotides may be purified from a cell in which they naturally occur. Conventional nucleic acid purification methods known to skilled artisans may be used to obtain isolated polynucleotides. The term also embraces recombinant polynucleotides and chemically synthesized polynucleotides.

The term "fragment" refers to a contiguous set of nucleotides or amino acids. In one embodiment, a fragment is 2, 3, 4, 5, 6, 7 8, 9, 10, 11, 12, 13, 14, 15, 16, 17, 18, 19, 20, or greater than 20 contiguous nucleotides. In one embodiment, a fragment is 2, 3, 4, 5, 6, 7 8, 9, 10, 11, 12, 13, 14, 15, 16, 17, 18, 19, 20, or greater than 20 contiguous amino acids. A fragment may or may not exhibit the function of a sequence sharing some percent identity over the length of said fragment.

The terms "fragment that is functionally equivalent" and "functionally equivalent fragment" are used interchangeably herein. These terms refer to a portion or subsequence of an isolated nucleic acid fragment or polypeptide that displays the same activity or function as the longer sequence from which it derives. In one example, the fragment retains the ability to alter gene expression or produce a certain phenotype whether or not the fragment encodes an active protein. For example, the fragment can be used in the design of genes to produce the desired phenotype in a modified plant. Genes can be designed for use in suppression by linking a nucleic acid fragment, whether or not it encodes an active enzyme, in the sense or antisense orientation relative to a plant promoter sequence.

"Gene" includes a nucleic acid fragment that expresses a functional molecule such as, but not limited to, a specific protein, including regulatory sequences preceding (5' non-coding sequences) and following (3' non-coding sequences) the coding sequence. "Native gene" refers to a gene as found in its natural endogenous location with its own regulatory sequences.

By the term "endogenous" it is meant a sequence or other molecule that naturally occurs in a cell or organism. In one aspect, an endogenous polynucleotide is normally found in the genome of a cell; that is, not heterologous.

An "allele" is one of several alternative forms of a gene occupying a given locus on a chromosome. When all the alleles present at a given locus on a chromosome are the same, that plant is homozygous at that locus. If the alleles present at a given locus on a chromosome differ, that plant is heterozygous at that locus.

"Coding sequence" refers to a polynucleotide sequence which codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences include, but are not limited to, promoters, translation leader sequences, 5' untranslated sequences, 3' untranslated sequences, introns, polyadenylation target sequences, RNA processing sites, effector binding sites, and stem-loop structures.

A "mutated gene" is a gene that has been altered through human intervention. Such a "mutated gene" has a sequence that differs from the sequence of the corresponding non-mutated gene by at least one nucleotide addition, deletion, or substitution. In certain embodiments of the disclosure, the mutated gene comprises an alteration that results from a guide polynucleotide/Cas endonuclease system as disclosed herein. A mutated plant is a plant comprising a mutated gene.

As used herein, a "targeted mutation" is a mutation in a gene (referred to as the target gene), including a native gene, that was made by altering a target sequence within the target gene using any method known to one skilled in the art, including a method involving a guided Cas endonuclease system as disclosed herein.

The terms "knock-out", "gene knock-out" and "genetic knock-out" are used interchangeably herein. A knock-out represents a DNA sequence of a cell that has been rendered partially or completely inoperative by targeting with a Cas protein; for example, a DNA sequence prior to knock-out could have encoded an amino acid sequence, or could have had a regulatory function (e.g., promoter).

The terms "knock-in", "gene knock-in, "gene insertion" and "genetic knock-in" are used interchangeably herein. A knock-in represents the replacement or insertion of a DNA sequence at a specific DNA sequence in cell by targeting with a Cas protein (for example by homologous recombination (HR), wherein a suitable donor DNA polynucleotide is also used). examples of knock-ins are a specific insertion of a heterologous amino acid coding sequence in a coding region of a gene, or a specific insertion of a transcriptional regulatory element in a genetic locus.

By "domain" it is meant a contiguous stretch of nucleotides (that can be RNA, DNA, and/or RNA-DNA-combination sequence) or amino acids.

The term "conserved domain" or "motif" means a set of polynucleotides or amino acids conserved at specific positions along an aligned sequence of evolutionarily related proteins. While amino acids at other positions can vary between homologous proteins, amino acids that are highly conserved at specific positions indicate amino acids that are essential to the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

A "codon-modified gene" or "codon-preferred gene" or "codon-optimized gene" is a gene having its frequency of codon usage designed to mimic the frequency of preferred codon usage of the host cell.

An "optimized" polynucleotide is a sequence that has been optimized for improved expression in a particular heterologous host cell.

A "plant-optimized nucleotide sequence" is a nucleotide sequence that has been optimized for expression in plants, particularly for increased expression in plants. A plant-optimized nucleotide sequence includes a codon-optimized gene. A plant-optimized nucleotide sequence can be synthesized by modifying a nucleotide sequence encoding a protein such as, for example, a Cas endonuclease as disclosed herein, using one or more plant-preferred codons for improved expression. See, for example, Campbell and Gowri (1990) *Plant Physiol.* 92:1-11 for a discussion of host-preferred codon usage.

A "promoter" is a region of DNA involved in recognition and binding of RNA polymerase and other proteins to initiate transcription. The promoter sequence consists of proximal and more distal upstream elements, the latter elements often referred to as enhancers. An "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, and/or comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

Promoters that cause a gene to be expressed in most cell types at most times are commonly referred to as "constitutive promoters". The term "inducible promoter" refers to a promoter that selectively express a coding sequence or functional RNA in response to the presence of an endogenous or exogenous stimulus, for example by chemical compounds (chemical inducers) or in response to environmental, hormonal, chemical, and/or developmental signals. Inducible or regulated promoters include, for example, promoters induced or regulated by light, heat, stress, flooding or drought, salt stress, osmotic stress, phytohormones, wounding, or chemicals such as ethanol, abscisic acid (ABA), jasmonate, salicylic acid, or safeners.

"Translation leader sequence" refers to a polynucleotide sequence located between the promoter sequence of a gene and the coding sequence. The translation leader sequence is present in the mRNA upstream of the translation start sequence. The translation leader sequence may affect processing of the primary transcript to mRNA, mRNA stability or translation efficiency. Examples of translation leader sequences have been described (e.g., Turner and Foster, (1995) *Mol Biotechnol* 3:225-236).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., (1989) *Plant Cell* 1:671-680.

"RNA transcript" refers to the product resulting from RNA polymerase-catalyzed transcription of a DNA sequence. When the RNA transcript is a perfect complimentary copy of the DNA sequence, it is referred to as the primary transcript or pre-mRNA. A RNA transcript is referred to as the mature RNA or mRNA when it is a RNA sequence derived from post-transcriptional processing of the primary transcript pre-mRNA. "Messenger RNA" or "mRNA" refers to the RNA that is without introns and that can be translated into protein by the cell. "cDNA" refers to a DNA that is complementary to, and synthesized from, an mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (see, e.g., U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "genome" refers to the entire complement of genetic material (genes and non-coding sequences) that is present in each cell of an organism, or virus or organelle; and/or a complete set of chromosomes inherited as a (haploid) unit from one parent.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions can be operably linked, either directly or indirectly, 5' to the target mRNA, or 3' to the target mRNA, or within the target mRNA, or a first complementary region is 5' and its complement is 3' to the target mRNA.

Generally, "host" refers to an organism or cell into which a heterologous component (polynucleotide, polypeptide, other molecule, cell) has been introduced. As used herein, a "host cell" refers to an in vivo or in vitro eukaryotic cell, prokaryotic cell (e.g., bacterial or archaeal cell), or cell from a multicellular organism (e.g., a cell line) cultured as a unicellular entity, into which a heterologous polynucleotide or polypeptide has been introduced. In some embodiments, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, an insect cell, a mammalian cell, a pig cell, a cow cell, a goat cell, a sheep cell, a rodent cell, a rat cell, a mouse cell, a non-human primate cell, and a human cell. In some cases, the cell is in vitro. In some cases, the cell is in vivo.

The term "recombinant" refers to an artificial combination of two otherwise separated segments of sequence, e.g., by chemical synthesis, or manipulation of isolated segments of nucleic acids by genetic engineering techniques.

The terms "plasmid", "vector" and "cassette" refer to a linear or circular extra chromosomal element often carrying genes that are not part of the central metabolism of the cell, and usually in the form of double-stranded DNA. Such elements may be autonomously replicating sequences, genome integrating sequences, phage, or nucleotide sequences, in linear or circular form, of a single- or double-stranded DNA or RNA, derived from any source, in which a number of nucleotide sequences have been joined or recombined into a unique construction which is capable of introducing a polynucleotide of interest into a cell. "Transformation cassette" refers to a specific vector comprising a gene and having elements in addition to the gene that facilitates transformation of a particular host cell. "Expression cassette" refers to a specific vector comprising a gene and having elements in addition to the gene that allow for expression of that gene in a host.

The terms "recombinant DNA molecule", "recombinant DNA construct", "expression construct", "construct", and "recombinant construct" are used interchangeably herein. A recombinant DNA construct comprises an artificial combination of nucleic acid sequences, e.g., regulatory and coding sequences that are not all found together in nature. For example, a recombinant DNA construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to introduce the vector into the host cells as is well known to those skilled in the art. For example, a plasmid vector can be used. The skilled artisan is well aware of the genetic elements that must be present on the vector in order to successfully transform, select and propagate host cells. The skilled artisan will also recognize that different independent transformation events may result in different levels and patterns of expression (Jones et al., (1985) *EMBO J* 4:2411-2418; De Almeida et al., (1989) *Mol Gen Genetics* 218:78-86), and thus that multiple events are typically screened in order to obtain lines displaying the desired expression level and pattern. Such screening may be accomplished standard molecular biological, biochemical, and other assays including Southern analysis of DNA, Northern analysis of mRNA expression, PCR, real time quantitative PCR (qPCR), reverse transcription PCR (RT-PCR), immunoblotting analysis of protein expression, enzyme or activity assays, and/or phenotypic analysis.

The term "heterologous" refers to the difference between the original environment, location, or composition of a particular polynucleotide or polypeptide sequence and its current environment, location, or composition. Non-limiting examples include differences in taxonomic derivation (e.g., a polynucleotide sequence obtained from *Zea mays* would be heterologous if inserted into the genome of an *Oryza sativa* plant, or of a different variety or cultivar of *Zea mays*; or a polynucleotide obtained from a bacterium was introduced into a cell of a plant), or sequence (e.g., a polynucleotide sequence obtained from *Zea mays*, isolated, modified, and re-introduced into a maize plant). As used herein, "heterologous" in reference to a sequence can refer to a sequence that originates from a different species, variety, foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. Alternatively, one or more regulatory region(s) and/or a polynucleotide provided herein may be entirely synthetic. In another example, a target polynucleotide for cleavage by a Cas endonuclease may be of a different organism than that of the Cas endonuclease. In another example, a Cas endonuclease and guide RNA may be introduced to a target polynucleotide with an additional polynucleotide that acts as a template or donor for insertion into the target polynucleotide, wherein the additional polynucleotide is heterologous to the target polynucleotide and/or the Cas endonuclease.

The term "expression", as used herein, refers to the production of a functional end-product (e.g., an mRNA, guide RNA, or a protein) in either precursor or mature form.

A "mature" protein refers to a post-translationally processed polypeptide (i.e., one from which any pre- or propeptides present in the primary translation product have been removed).

"Precursor" protein refers to the primary product of translation of mRNA (i.e., with pre- and propeptides still present). Pre- and propeptides may be but are not limited to intracellular localization signals.

"CRISPR" (Clustered Regularly Interspaced Short Palindromic Repeats) loci refers to certain genetic loci encoding components of DNA cleavage systems, for example, used by bacterial and archaeal cells to destroy foreign DNA (Horvath and Barrangou, 2010, *Science* 327:167-170; WO2007025097, published 1 Mar. 2007). A CRISPR locus can consist of a CRISPR array, comprising short direct repeats (CRISPR repeats) separated by short variable DNA sequences (called spacers), which can be flanked by diverse Cas (CRISPR-associated) genes.

As used herein, an "effector" or "effector protein" is a protein that encompasses an activity including recognizing, binding to, and/or cleaving or nicking a polynucleotide target. An effector, or effector protein, may also be an endonuclease. The "effector complex" of a CRISPR system includes Cas proteins involved in crRNA and target recognition and binding. Some of the component Cas proteins may additionally comprise domains involved in target polynucleotide cleavage.

The term "Cas protein" refers to a polypeptide encoded by a Cas (CRISPR-associated) gene. A Cas protein includes proteins encoded by a gene in a cas locus, and include adaptation molecules as well as interference molecules. An interference molecule of a bacterial adaptive immunity complex includes endonucleases. A Cas endonuclease described herein comprises one or more nuclease domains. A Cas endonuclease includes but is not limited to: the novel Cas-alpha protein disclosed herein, a Cas9 protein, a Cpf1 (Cas12) protein, a C2c1 protein, a C2c2 protein, a C2c3 protein, Cas3, Cas3-HD, Cas 5, Cas7, Cas8, Cas10, or combinations or complexes of these. A Cas protein may be a "Cas endonuclease" or "Cas effector protein", that when in complex with a suitable polynucleotide component, is capable of recognizing, binding to, and optionally nicking or cleaving all or part of a specific polynucleotide target sequence. The Cas-alpha endonucleases of the disclosure include those having one or more RuvC nuclease domains. A Cas protein is further defined as a functional fragment or functional variant of a native Cas protein, or a protein that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, or greater than 500 contiguous amino acids of a native Cas protein, and retains at least partial activity of the native sequence.

A "functional fragment", "fragment that is functionally equivalent" and "functionally equivalent fragment" of a Cas endonuclease are used interchangeably herein, and refer to a portion or subsequence of the Cas endonuclease of the present disclosure in which the ability to recognize, bind to, and optionally unwind, nick or cleave (introduce a single or double-strand break in) the target site is retained. The portion or subsequence of the Cas endonuclease can comprise a complete or partial (functional) peptide of any one of its domains such as for example, but not limiting to a complete of functional part of a Cas3 HD domain, a complete of functional part of a Cas3 Helicase domain, complete of functional part of a protein (such as but not limiting to a Cas5, Cas5d, Cas? and Cas8b1).

The terms "functional variant", "variant that is functionally equivalent" and "functionally equivalent variant" of a Cas endonuclease or Cas effector protein, including Cas-alpha described herein, are used interchangeably herein, and refer to a variant of the Cas effector protein disclosed herein in which the ability to recognize, bind to, and optionally unwind, nick or cleave all or part of a target sequence is retained.

A Cas endonuclease may also include a multifunctional Cas endonuclease. The term "multifunctional Cas endonuclease" and "multifunctional Cas endonuclease polypeptide" are used interchangeably herein and includes reference to a single polypeptide that has Cas endonuclease functionality (comprising at least one protein domain that can act as a Cas endonuclease) and at least one other functionality, such as but not limited to, the functionality to form a complex (comprises at least a second protein domain that can form a complex with other proteins). In one aspect, the multifunctional Cas endonuclease comprises at least one additional protein domain relative (either internally, upstream (5'), downstream (3'), or both internally 5' and 3', or any combination thereof) to those domains typical of a Cas endonuclease.

The terms "cascade" and "cascade complex" are used interchangeably herein and include reference to a multi-subunit protein complex that can assemble with a polynucleotide forming a polynucleotide-protein complex (PNP). Cascade is a PNP that relies on the polynucleotide for complex assembly and stability, and for the identification of target nucleic acid sequences. Cascade functions as a surveillance complex that finds and optionally binds target nucleic acids that are complementary to a variable targeting domain of the guide polynucleotide.

The terms "cleavage-ready Cascade", "crCascade", "cleavage-ready Cascade complex", "crCascade complex", "cleavage-ready Cascade system", "CRC" and "crCascade system", are used interchangeably herein and include reference to a multi-subunit protein complex that can assemble with a polynucleotide forming a polynucleotide-protein complex (PNP), wherein one of the cascade proteins is a Cas endonuclease capable of recognizing, binding to, and optionally unwinding, nicking, or cleaving all or part of a target sequence.

The terms "5'-cap" and "7-methylguanylate (m7G) cap" are used interchangeably herein. A 7-methylguanylate residue is located on the 5' terminus of messenger RNA (mRNA) in eukaryotes. RNA polymerase II (Pol II) transcribes mRNA in eukaryotes. Messenger RNA capping occurs generally as follows: the most terminal 5' phosphate group of the mRNA transcript is removed by RNA terminal phosphatase, leaving two terminal phosphates. A guanosine monophosphate (GMP) is added to the terminal phosphate of the transcript by a guanylyl transferase, leaving a 5'-5' triphosphate-linked guanine at the transcript terminus. Finally, the 7-nitrogen of this terminal guanine is methylated by a methyl transferase.

The terminology "not having a 5'-cap" herein is used to refer to RNA having, for example, a 5'-hydroxyl group instead of a 5'-cap. Such RNA can be referred to as "uncapped RNA", for example. Uncapped RNA can better accumulate in the nucleus following transcription, since 5'-capped RNA is subject to nuclear export. One or more RNA components herein are uncapped.

As used herein, the term "guide polynucleotide", relates to a polynucleotide sequence that can form a complex with a Cas endonuclease, including the Cas endonuclease described herein, and enables the Cas endonuclease to recognize, optionally bind to, and optionally cleave a DNA target site. The guide polynucleotide sequence can be a RNA sequence, a DNA sequence, or a combination thereof (a RNA-DNA combination sequence).

The terms "functional fragment", "fragment that is functionally equivalent" and "functionally equivalent fragment" of a guide RNA, crRNA or tracrRNA are used interchangeably herein, and refer to a portion or subsequence of the guide RNA, crRNA or tracrRNA, respectively, of the present disclosure in which the ability to function as a guide RNA, crRNA or tracrRNA, respectively, is retained.

The terms "functional variant", "variant that is functionally equivalent" and "functionally equivalent variant" of a guide RNA, crRNA or tracrRNA (respectively) are used interchangeably herein, and refer to a variant of the guide RNA, crRNA or tracrRNA, respectively, of the present disclosure in which the ability to function as a guide RNA, crRNA or tracrRNA, respectively, is retained.

The terms "single guide RNA" and "sgRNA" are used interchangeably herein and relate to a synthetic fusion of two RNA molecules, a crRNA (CRISPR RNA) comprising a variable targeting domain (linked to a tracr mate sequence that hybridizes to a tracrRNA), fused to a tracrRNA (trans-activating CRISPR RNA). The single guide RNA can comprise a crRNA or crRNA fragment and a tracrRNA or tracrRNA fragment of the type II CRISPR/Cas system that can form a complex with a type II Cas endonuclease, wherein said guide RNA/Cas endonuclease complex can direct the Cas endonuclease to a DNA target site, enabling the Cas endonuclease to recognize, optionally bind to, and optionally nick or cleave (introduce a single or double-strand break) the DNA target site.

The term "variable targeting domain" or "VT domain" is used interchangeably herein and includes a nucleotide sequence that can hybridize (is complementary) to one strand (nucleotide sequence) of a double strand DNA target site. The percent complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable targeting domain can be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" (of a guide polynucleotide) is used interchangeably herein and includes a nucleotide sequence that interacts with a Cas endonuclease polypeptide. A CER domain comprises a (trans-acting) tracrNucleotide mate sequence followed by a tracrNucleotide sequence. The CER domain can be composed of a DNA sequence, a RNA sequence, a modified DNA sequence, a modified RNA sequence (see for example US20150059010A1, published 26 Feb. 2015), or any combination thereof.

As used herein, the terms "guide polynucleotide/Cas endonuclease complex", "guide polynucleotide/Cas endonuclease system", "guide polynucleotide/Cas complex", "guide polynucleotide/Cas system" and "guided Cas system" "Polynucleotide-guided endonuclease", "PGEN" are used interchangeably herein and refer to at least one guide polynucleotide and at least one Cas endonuclease, that are capable of forming a complex, wherein said guide polynucleotide/Cas endonuclease complex can direct the Cas endonuclease to a DNA target site, enabling the Cas endonuclease to recognize, bind to, and optionally nick or cleave (introduce a single or double-strand break) the DNA target site. A guide polynucleotide/Cas endonuclease complex herein can comprise Cas protein(s) and suitable polynucleotide component(s) of any of the known CRISPR systems (Horvath and Barrangou, 2010, Science 327:167-170; Makarova et al. 2015, Nature Reviews Microbiology Vol. 13:1-15; Zetsche et al., 2015, Cell 163, 1-13; Shmakov et al., 2015, Molecular Cell 60, 1-13).

The terms "guide RNA/Cas endonuclease complex", "guide RNA/Cas endonuclease system", "guide RNA/Cas complex", "guide RNA/Cas system", "gRNA/Cas complex", "gRNA/Cas system", "RNA-guided endonuclease", "RGEN" are used interchangeably herein and refer to at least one RNA component and at least one Cas endonuclease that are capable of forming a complex, wherein said guide RNA/Cas endonuclease complex can direct the Cas endonuclease to a DNA target site, enabling the Cas endonuclease to recognize, bind to, and optionally nick or cleave (introduce a single or double-strand break) the DNA target site.

The terms "target site", "target sequence", "target site sequence, "target DNA", "target locus", "genomic target site", "genomic target sequence", "genomic target locus" and "protospacer", are used interchangeably herein and refer to a polynucleotide sequence such as, but not limited to, a nucleotide sequence on a chromosome, episome, a locus, or any other DNA molecule in the genome (including chromosomal, chloroplastic, mitochondrial DNA, plasmid DNA) of a cell, at which a guide polynucleotide/Cas endonuclease complex can recognize, bind to, and optionally nick or cleave. The target site can be an endogenous site in the genome of a cell, or alternatively, the target site can be heterologous to the cell and thereby not be naturally occurring in the genome of the cell, or the target site can be found in a heterologous genomic location compared to where it occurs in nature. As used herein, terms "endogenous target sequence" and "native target sequence" are used interchangeable herein to refer to a target sequence that is endogenous or native to the genome of a cell and is at the endogenous or native position of that target sequence in the genome of the cell. An "artificial target site" or "artificial target sequence" are used interchangeably herein and refer to a target sequence that has been introduced into the genome of a cell. Such an artificial target sequence can be identical in sequence to an endogenous or native target sequence in the genome of a cell but be located in a different position (i.e., a non-endogenous or non-native position) in the genome of a cell.

A "protospacer adjacent motif" (PAM) herein refers to a short nucleotide sequence adjacent to a target sequence (protospacer) that is recognized (targeted) by a guide polynucleotide/Cas endonuclease system described herein. The Cas endonuclease may not successfully recognize a target DNA sequence if the target DNA sequence is not followed by a PAM sequence. The sequence and length of a PAM herein can differ depending on the Cas protein or Cas protein complex used. The PAM sequence can be of any length but is typically 1, 2, 3, 4, 5, 6, 7, 8, 9, 10, 11, 12, 13, 14, 15, 16, 17, 18, 19 or 20 nucleotides long.

An "altered target site", "altered target sequence", "modified target site", "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, (iv) a chemical alteration of at least one nucleotide, or (v) any combination of (i)-(iv).

A "modified nucleotide" or "edited nucleotide" refers to a nucleotide sequence of interest that comprises at least one alteration when compared to its non-modified nucleotide sequence. Such "alterations" include, for example: (i) replacement of at least one nucleotide, (ii) a deletion of at least one nucleotide, (iii) an insertion of at least one nucleotide, (iv) a chemical alteration of at least one nucleotide, or (v) any combination of (i)-(iv).

Methods for "modifying a target site" and "altering a target site" are used interchangeably herein and refer to methods for producing an altered target site.

As used herein, "donor DNA" is a DNA construct that comprises a polynucleotide of interest to be inserted into the target site of a Cas endonuclease.

The term "polynucleotide modification template" includes a polynucleotide that comprises at least one nucleotide modification when compared to the nucleotide sequence to be edited. A nucleotide modification can be at least one nucleotide substitution, addition or deletion. Optionally, the polynucleotide modification template can further comprise homologous nucleotide sequences flanking the at least one nucleotide modification, wherein the flanking homologous nucleotide sequences provide sufficient homology to the desired nucleotide sequence to be edited.

The term "plant-optimized Cas endonuclease" herein refers to a Cas protein, including a multifunctional Cas protein, encoded by a nucleotide sequence that has been optimized for expression in a plant cell or plant.

A "plant-optimized nucleotide sequence encoding a Cas endonuclease", "plant-optimized construct encoding a Cas endonuclease" and a "plant-optimized polynucleotide encoding a Cas endonuclease" are used interchangeably herein and refer to a nucleotide sequence encoding a Cas protein, or a variant or functional fragment thereof, that has been optimized for expression in a plant cell or plant. A plant comprising a plant-optimized Cas endonuclease includes a plant comprising the nucleotide sequence encoding for the Cas sequence and/or a plant comprising the Cas endonuclease protein. In one aspect, the plant-optimized Cas endonuclease nucleotide sequence is a maize-optimized, rice-optimized, wheat-optimized, soybean-optimized, cotton-optimized, or canola-optimized Cas endonuclease.

The term "plant" generically includes whole plants, plant organs, plant tissues, seeds, plant cells, seeds and progeny of the same. The plant is a monocot or dicot. Plant cells include, without limitation, cells from seeds, suspension cultures, embryos, meristematic regions, callus tissue, leaves, roots, shoots, gametophytes, sporophytes, pollen and microspores. A "plant element" is intended to reference either a whole plant or a plant component, which may comprise differentiated and/or undifferentiated tissues, for example but not limited to plant tissues, parts, and cell types. In one embodiment, a plant element is one of the following: whole plant, seedling, meristematic tissue, ground tissue, vascular tissue, dermal tissue, seed, leaf, root, shoot, stem, flower, fruit, stolon, bulb, tuber, corm, keiki, shoot, bud, tumor tissue, and various forms of cells and culture (e.g., single cells, protoplasts, embryos, callus tissue). It should be noted that a protoplast is not technically an "intact" plant cell (as naturally found with all components), as protoplasts lack a cell wall. The term "plant organ" refers to plant tissue or a group of tissues that constitute a morphologically and functionally distinct part of a plant. As used herein, a "plant element" is synonymous to a "portion" of a plant, and refers to any part of the plant, and can include distinct tissues and/or organs, and may be used interchangeably with the term "tissue" throughout. Similarly, a "plant reproductive element" is intended to generically reference any part of a plant that is able to initiate other plants via either sexual or asexual reproduction of that plant, for example but not limited to: seed, seedling, root, shoot, cutting, scion, graft, stolon, bulb, tuber, corm, keiki, or bud. The plant element may be in plant or in a plant organ, tissue culture, or cell culture.

"Progeny" comprises any subsequent generation of a plant.

As used herein, the term "plant part" refers to plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like, as well as the parts themselves. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The term "monocotyledonous" or "monocot" refers to the subclass of angiosperm plants also known as "monocotyledoneae", whose seeds typically comprise only one embryonic leaf, or cotyledon. The term includes references to whole plants, plant elements, plant organs (e.g., leaves, stems, roots, etc.), seeds, plant cells, and progeny of the same.

The term "dicotyledonous" or "dicot" refers to the subclass of angiosperm plants also knows as "dicotyledoneae", whose seeds typically comprise two embryonic leaves, or cotyledons. The term includes references to whole plants, plant elements, plant organs (e.g., leaves, stems, roots, etc.), seeds, plant cells, and progeny of the same.

As used herein, a "male sterile plant" is a plant that does not produce male gametes that are viable or otherwise capable of fertilization. As used herein, a "female sterile plant" is a plant that does not produce female gametes that are viable or otherwise capable of fertilization. It is recognized that male-sterile and female-sterile plants can be female-fertile and male-fertile, respectively. It is further recognized that a male fertile (but female sterile) plant can produce viable progeny when crossed with a female fertile plant and that a female fertile (but male sterile) plant can produce viable progeny when crossed with a male fertile plant.

The term "non-conventional yeast" herein refers to any yeast that is not a *Saccharomyces* (e.g., *S. cerevisiae*) or *Schizosaccharomyces* yeast species. (see "Non-Conventional Yeasts in Genetics, Biochemistry and Biotechnology: Practical Protocols", K. Wolf, K. D. Breunig, G. Barth, Eds., Springer-Verlag, Berlin, Germany, 2003).

The term "crossed" or "cross" or "crossing" in the context of this disclosure means the fusion of gametes via pollination to produce progeny (i.e., cells, seeds, or plants). The term encompasses both sexual crosses (the pollination of one plant by another) and selfing (self-pollination, i.e., when the pollen and ovule (or microspores and megaspores) are from the same plant or genetically identical plants).

The term "introgression" refers to the transmission of a desired allele of a genetic locus from one genetic background to another. For example, introgression of a desired allele at a specified locus can be transmitted to at least one progeny plant via a sexual cross between two parent plants, where at least one of the parent plants has the desired allele within its genome. Alternatively, for example, transmission of an allele can occur by recombination between two donor genomes, e.g., in a fused protoplast, where at least one of the donor protoplasts has the desired allele in its genome. The desired allele can be, e.g., a transgene, a modified (mutated or edited) native allele, or a selected allele of a marker or QTL.

The term "isoline" is a comparative term, and references organisms that are genetically identical, but differ in treatment. In one example, two genetically identical maize plant embryos may be separated into two different groups, one receiving a treatment (such as the introduction of a CRISPR-Cas effector endonuclease) and one control that does not receive such treatment. Any phenotypic differences between the two groups may thus be attributed solely to the treatment and not to any inherency of the plant's endogenous genetic makeup.

"Introducing" is intended to mean presenting to a target, such as a cell or organism, a polynucleotide or polypeptide or polynucleotide-protein complex, in such a manner that the component(s) gains access to the interior of a cell of the organism or to the cell itself.

A "polynucleotide of interest" includes any nucleotide sequence encoding a protein or polypeptide that improves desirability of crops, i.e. a trait of agronomic interest. Polynucleotides of interest include, but are not limited to: polynucleotides encoding important traits for agronomics, herbicide-resistance, insecticidal resistance, disease resistance, nematode resistance, herbicide resistance, microbial resistance, fungal resistance, viral resistance, fertility or sterility, grain characteristics, commercial products, phenotypic marker, or any other trait of agronomic or commercial importance. A polynucleotide of interest may additionally be utilized in either the sense or anti-sense orientation. Further, more than one polynucleotide of interest may be utilized together, or "stacked", to provide additional benefit.

A "complex trait locus" includes a genomic locus that has multiple transgenes genetically linked to each other.

The compositions and methods herein may provide for an improved "agronomic trait" or "trait of agronomic importance" or "trait of agronomic interest" to a plant, which may include, but not be limited to, the following: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, as compared to an isoline plant not comprising a modification derived from the methods or compositions herein.

"Agronomic trait potential" is intended to mean a capability of a plant element for exhibiting a phenotype, preferably an improved agronomic trait, at some point during its life cycle, or conveying said phenotype to another plant element with which it is associated in the same plant.

The terms "decreased," "fewer," "slower" and "increased" "faster" "enhanced" "greater" as used herein refers to a decrease or increase in a characteristic of the modified plant element or resulting plant compared to an unmodified plant element or resulting plant. For example, a decrease in a characteristic may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400% or more lower than the untreated control and an increase may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400% or more higher than the untreated control.

As used herein, the term "before", in reference to a sequence position, refers to an occurrence of one sequence upstream, or 5', to another sequence.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" or "umole" mean micromole(s), "g" means gram(s), "μg" or "ug" means microgram(s), "ng" means nanogram(s), "U" means unit(s), "bp" means base pair(s) and "kb" means kilobase(s).

Classification of CRISPR-Cas Systems

CRISPR-Cas systems have been classified according to sequence and structural analysis of components. Multiple CRISPR/Cas systems have been described including Class 1 systems, with multisubunit effector complexes (comprising type I, type III, and type IV), and Class 2 systems, with single protein effectors (comprising type II, type V, and type VI) (Makarova et al. 2015, *Nature Reviews Microbiology* Vol. 13:1-15; Zetsche et al., 2015, *Cell* 163, 1-13; Shmakov et al., 2015, *Molecular Cell* 60, 1-13; Haft et al., 2005, *Computational Biology, PLoS Comput Biol* 1(6):e60; and Koonin et al. 2017, *Curr Opinion Microbiology* 37:67-78).

A CRISPR-Cas system comprises, at a minimum, a CRISPR RNA (crRNA) molecule and at least one CRISPR-associated (Cas) protein to form crRNA ribonucleoprotein (crRNP) effector complexes. CRISPR-Cas loci comprise an array of identical repeats interspersed with DNA-targeting spacers that encode the crRNA components and an operon-like unit of cas genes encoding the Cas protein components. The resulting ribonucleoprotein complex recognizes a polynucleotide in a sequence-specific manner (Jore et al., *Nature Structural & Molecular Biology* 18, 529-536 (2011)). The crRNA serves as a guide RNA for sequence specific binding of the effector (protein or complex) to double strand DNA sequences, by forming base pairs with the complementary DNA strand while displacing the noncomplementary strand to form a so called R-loop. (Jore et al., 2011. *Nature Structural & Molecular Biology* 18, 529-536).

RNA transcripts of CRISPR loci (pre-crRNA) are cleaved specifically in the repeat sequences by CRISPR associated (Cas) endoribonucleases in type I and type III systems or by RNase III in type II systems. The number of CRISPR-associated genes at a given CRISPR locus can vary between species.

Different cas genes that encode proteins with different domains are present in different CRISPR systems. The cas operon comprises genes that encode for one or more effector endonucleases, as well as other Cas proteins. Protein subunits include those described in Makarova et al. 2011, *Nat Rev Microbiol.* 2011 9(6):467-477; Makarova et al. 2015, *Nature Reviews Microbiology* Vol. 13:1-15; and Koonin et al. 2017, *Current Opinion Microbiology* 37:67-78). The types of domains include those involved in Expression (pre-crRNA processing, for example Cas 6 or RNaseIII), Interference (including an effector module for crRNA and target binding, as well as domain(s) for target cleavage), Adaptation (spacer insertion, for example Cas1 or Cas2), and Ancillary (regulation or helper or unknown function). Some domains may serve more than one purpose, for example Cas9 comprises domains for endonuclease functionality as well as for target cleavage, among others.

The Cas endonuclease is guided by a single CRISPR RNA (crRNA) through direct RNA-DNA base-pairing to recognize a DNA target site that is in close vicinity to a protospacer adjacent motif (PAM) (Jore, M. M. et al., 2011, *Nat. Struct. Mol. Biol.* 18:529-536, Westra, E. R. et al., 2012, *Molecular Cell* 46:595-605, and Sinkunas, T. et al., 2013, *EMBO J.* 32:385-394).

Class I CRISPR-Cas Systems

Class I CRISPR-Cas systems comprise Types I, III, and IV. A characteristic feature of Class I systems is the presence of an effector endonuclease complex instead of a single protein. A Cascade complex comprises a RNA recognition motif (RRM) and a nucleic acid-binding domain that is the core fold of the diverse RAMP (Repeat-Associated Mysterious Proteins) protein superfamily (Makarova et al. 2013, *Biochem Soc Trans* 41, 1392-1400; Makarova et al. 2015, *Nature Reviews Microbiology* Vol. 13:1-15). RAMP protein subunits include Cas5 and Cas7 (which comprise the skeleton of the crRNA—effector complex), wherein the Cas5 subunit binds the 5' handle of the crRNA and interacts with the large subunit, and often includes Cas6 which is loosely associated with the effector complex and typically functions as the repeat-specific RNase in the pre-crRNA processing (Charpentier et al., *FEMS Microbiol Rev* 2015, 39:428-441; Niewoehner et al., *RNA* 2016, 22:318-329).

Type I CRISPR-Cas systems comprise a complex of effector proteins, termed Cascade (CRISPR-associated complex for antiviral defense) comprising at a minimum Cas5 and Cas7. The effector complex functions together with a single CRISPR RNA (crRNA) and Cas3 to defend against invading viral DNA (Brouns, S. J. J. et al. *Science* 321:960-964; Makarova et al. 2015, *Nature Reviews Microbiology* Vol. 13:1-15). Type I CRISPR-Cas loci comprise the signature gene cas3 (or a variant cas3' or cas3"), which encodes a metal-dependent nuclease that possesses a single-stranded DNA (ssDNA)-stimulated superfamily 2 helicase with a demonstrated capacity to unwind double stranded DNA (dsDNA) and RNA-DNA duplexes (Makarova et al. 2015, *Nature Reviews; Microbiology* Vol. 13:1-15). Following target recognition, the Cas3 endonuclease is recruited to the Cascade-crRNA-target DNA complex to cleave and degrade the DNA target (Westra, E. R. et al. (2012) *Molecular Cell* 46:595-605, Sinkunas, T. et al. (2011) *EMBO J.* 30:1335-1342, and Sinkunas, T. et al. (2013) *EMBO J.* 32:385-394). In some type I systems, Cas6 can be the active endonuclease that is responsible for crRNA processing, and Cas5 and Cas7 function as non-catalytic RNA-binding proteins; although in type I-C systems, crRNA processing can be catalyzed by Cas5 (Makarova et al. 2015, *Nature Reviews Microbiology* Vol. 13:1-15). Type I systems are divided into seven subtypes (Makarova et al. 2011, *Nat Rev Microbiol.* 2011 9(6):467-477; Koonin et al. 2017, *Curr Opinion Microbiology* 37:67-78). A modified type I CRISPR-associated complex for adaptive antiviral defense (Cascade) comprising at least the protein subunits Cas7, Cas5 and Cas6, wherein one of these subunits is synthetically fused to a Cas3 endonuclease or a modified restriction endonuclease, FokI, have been described (WO2013098244 published 4 Jul. 4 2013).

Type III CRISPR-Cas systems, comprising a plurality of cas7 genes, target either ssRNA or ssDNA, and function as either an RNase as well as a target RNA-activated DNA nuclease (Tamulaitis et al., *Trends in Microbiology* 25(10) 49-61, 2017). Csm (Type III-A) and Cmr (Type III-B) complexes function as RNA-activated single-stranded (ss) DNases that couple the target RNA binding/cleavage with ssDNA degradation. Upon foreign DNA infection, the CRISPR RNA (crRNA)-guided binding of the Csm or Cmr complex to the emerging transcript recruits Cas10 DNase to the actively transcribed phage DNA, resulting in degradation of both the transcript and phage DNA, but not the host DNA. The Cas10 HD-domain is responsible for the ssDNase activity, and Csm3/Cmr4 subunits are responsible for the endoribonuclease activity of the Csm/Cmr complex. The 3'-flanking sequence of the target RNA is critical for the ssDNase activity of Csm/Cmr: the basepairing with the 5'-handle of crRNA protects host DNA from degradation.

Type IV systems, although comprising typical type I cas5 and cas7 domains in addition to a cas8-like domain, may lack the CRISPR array that is characteristic of most other CRISPR-Cas systems.

Class II CRISPR-Cas Systems

Class II CRISPR-Cas systems comprise Types II, V, and VI. A characteristic feature of Class II systems is the presence of a single Cas effector protein instead of an effector complex. Types II and V Cas proteins comprise an RuvC endonuclease domain that adopts the RNase H fold.

Type II CRISPR/Cas systems employ a crRNA and tracrRNA (trans-activating CRISPR RNA) to guide the Cas endonuclease to its DNA target. The crRNA comprises a spacer region complementary to one strand of the double strand DNA target and a region that base pairs with the tracrRNA (trans-activating CRISPR RNA) forming a RNA duplex that directs the Cas endonuclease to cleave the DNA target, leaving a blunt end. Spacers are acquired through a not fully understood process involving Cas1 and Cas2 proteins. Type II CRISPR/Cas loci typically comprise cas1 and cas2 genes in addition to the cas9 gene (Chylinski et al., 2013, *RNA Biology* 10:726-737; Makarova et al. 2015, *Nature Reviews Microbiology* Vol. 13:1-15). Type II CRISR-Cas loci can encode a tracrRNA, which is partially complementary to the repeats within the respective CRISPR array, and can comprise other proteins such as Csn1 and Csn2. The presence of cas9 in the vicinity of cas1 and cas2 genes is the hallmark of type II loci (Makarova et al. 2015, *Nature Reviews Microbiology* Vol. 13:1-15).

Type V CRISPR/Cas systems comprise a single Cas endonuclease, including Cpf1 (Cas12) (Koonin et al., *Curr Opinion Microbiology* 37:67-78, 2017), that is an active RNA-guided endonuclease that does not necessarily require the additional trans-activating CRISPR (tracr) RNA for target cleavage, unlike Cas9.

Type VI CRISPR-Cas systems comprise a cas13 gene that encodes a nuclease with two HEPN (Higher Eukaryotes and Prokaryotes Nucleotide-binding) domains but no HNH or RuvC domains, and are not dependent upon tracrRNA activity. The majority of HEPN domains comprise conserved motifs that constitute a metal-independent endoR- Nase active site (Anantharam et al., *Biol Direct* 8:15, 2013). Because of this feature, it is thought that type VI systems act on RNA targets instead of the DNA targets that are common to other CRISPR-Cas systems.

Novel CRISPR-Cas Systems

Disclosed herein is a novel CRISPR-Cas system, components thereof, and methods of using said components. The system comprises a novel Cas effector protein, Cas-alpha.

The novel CRISPR-Cas system components described herein may comprise one or more subunits from different Cas systems, subunits derived or modified from more than one different bacterial or archaeal prokaryote, and/or synthetic or engineered components.

Described herein is a newly identified CRISPR-Cas system comprising novel arrangements of cas genes. Further described are novel cas genes and proteins.

One feature of some of the novel Cas-alpha system is the locus architecture as depicted in FIGS. 1A-1D. In some aspects, the Cas-alpha genomic locus comprises a cas1 gene, a cas2 gene, a cas4 gene, and a cas-alpha gene encoding the effector protein Cas-alpha. A CRISPR array comprising repeats of a nucleotide sequence may be found prior to, or following, the gene encoding the Cas-alpha endonuclease. In some aspects, the cas-alpha locus may comprise a cas-alpha gene encoding an effector protein, and a CRISPR array comprising repeats, but not comprise any one or more of a cas1 gene, a cas2 gene, and/or a cas4 gene.

CRISPR-Cas System Components

Cas Proteins

A number of proteins may be encoded in the CRISPR cas operon, including those involved in adaptation (spacer insertion), interference (effector module target binding, target nicking or cleavage—e.g. endonuclease activity), expression (pre-crRNA processing), regulation, or other.

Two proteins, Cas1 and Cas2, are conserved among many CRISPR systems (for example, as described in Koonin et al., *Curr Opinion Microbiology* 37:67-78, 2017). Cas1 is a metal-dependent DNA-specific endonuclease that produces double-stranded DNA fragments. In some systems Cas1 forms a stable complex with Cas2, which is essential to spacer acquisition and insertion for CRISPR systems (Nuñez et al., *Nature Str Mol Biol* 21:528-534, 2014).

A number of other proteins have been identified across different systems, including Cas4 (which may have similarity to a RecB nuclease) and is thought to play a role in the capture of new viral DNA sequences for incorporation into the CRISPR array (Zhang et al., *PLOS One* 7(10):e47232, 2012).

Some proteins may encompass a plurality of functions. For example, Cas9, the signature protein of Class 2 type II systems, has been demonstrated to be involved in pre-crRNA processing, target binding, as well as target cleavage.

The novel Cas-alpha proteins disclosed herein include effector proteins (endonucleases) as well as adaptation proteins. Cas endonucleases have been identified from several bacterial and archaebacterial sources, and include those presented in FIGS. 7A-7K.

Cas Endonucleases and Effectors

Endonucleases are enzymes that cleave the phosphodiester bond within a polynucleotide chain, and include restriction endonucleases that cleave DNA at specific sites without damaging the bases. Examples of endonucleases include restriction endonucleases, meganucleases, TAL effector nucleases (TALENs), zinc finger nucleases, and Cas (CRISPR-associated) effector endonucleases.

Cas endonucleases, either as single effector proteins or in an effector complex with other components, unwind the DNA duplex at the target sequence and optionally cleave at least one DNA strand, as mediated by recognition of the target sequence by a polynucleotide (such as, but not limited to, a crRNA or guide RNA) that is in complex with the Cas effector protein. Such recognition and cutting of a target sequence by a Cas endonuclease typically occurs if the correct protospacer-adjacent motif (PAM) is located at or adjacent to the 3' end of the DNA target sequence. Alternatively, a Cas endonuclease herein may lack DNA cleavage or nicking activity, but can still specifically bind to a DNA target sequence when complexed with a suitable RNA component. (See also U.S. Patent Application US20150082478 published 19 Mar. 2015 and US20150059010 published 26 Feb. 2015).

Cas endonucleases may occur as individual effectors (Class 2 CRISPR systems) or as part of larger effector complexes (Class I CRISPR systems).

Cas endonucleases that have been described include, but are not limited to, for example:Cas3 (a feature of Class 1 type I systems), Cas9 (a feature of Class 2 type II systems) and Cas12 (Cpf1) (a feature of Class 2 type V systems). Cas3 (and its variants Cas3' and Cas3") functions as a single-stranded DNA nuclease (HD domain) and an ATP-dependent helicase. A variant of the Cas3 endonuclease can be obtained by disabling the functional activity of one or both domains of the Cas3 endonuclease poly peptide. Disabling the ATPase dependent helicase activity (by deletion, knockout of the Cas3-helicase domain, or through mutagenesis of critical residues or by assembling the reaction in the absence of ATP as described previously (Sinkunas, T. et al., 2013, *EMBO J.* 32:385-394) can convert the cleavage ready Cascade comprising the modified Cas3 endonuclease into a nickase (as the HD domain is still functional). Disabling the HD endonuclease activity can be accomplished by any method known in the art, such as but not limited to, mutagenesis of critical residues of the HD domain, can convert the cleavage ready Cascade comprising the modified Cas3 endonuclease into a helicase. Disabling the both the Cas helicase and Cas3 HD endonuclease activity can be accomplished by any method known in the art, such as but not limited to, mutagenesis of critical residues of both the helicase and HD domains, can convert the cleavage ready Cascade comprising the modified Cas3 endonuclease into a binder protein that binds to a target sequence.

Cas9 (formerly referred to as Cas5, Csn1, or Csx12) is a Cas endonuclease that forms a complex with a crNucleotide and a tracrNucleotide, or with a single guide polynucleotide, for specifically recognizing and cleaving all or part of a DNA target sequence. Cas9 recognizes a 3' GC-rich PAM sequence on the target dsDNA. A Cas9 protein comprises a RuvC nuclease with an HNH (H—N—H) nuclease adjacent to the RuvC-II domain. The RuvC nuclease and HNH nuclease each can cleave a single DNA strand at a target sequence (the concerted action of both domains leads to DNA double-strand cleavage, whereas activity of one domain leads to a nick). In general, the RuvC domain comprises subdomains I, II and III, where domain I is located near the N-terminus of Cas9 and subdomains II and III are located in the middle of the protein, flanking the HNH domain (Hsu et al., 2013, *Cell* 157:1262-1278). Cas9 endonucleases are typically derived from a type II CRISPR system, which includes a DNA cleavage system utilizing a Cas9 endonuclease in complex with at least one polynucleotide component. For example, a Cas9 can be in complex with a CRISPR RNA (crRNA) and a trans-activating CRISPR RNA (tracrRNA). In another example, a Cas9 can be in complex with a single guide RNA (Makarova et al. 2015, *Nature Reviews Microbiology* Vol. 13:1-15).

Cas12 (formerly referred to as Cpf1, and variants c2c1, c2c3, CasX, and CasY) comprise an RuvC nuclease domain and produced staggered, 5' overhangs on the dsDNA target. Some variants do not require a tracrRNA, unlike the functionality of Cas9. Cas12 and its variants recognize a 5' AT-rich PAM sequence on the target dsDNA. An insert domain, called Nuc, of the Cas12a protein has been demonstrated to be responsible for target strand cleavage (Yamano et al., *Cell* 2016, 165:949-962). Additional mutation studies in other Cas12 proteins demonstrated the Nuc domain contributes to guide and target binding, with the RuvC domain responsible for cleavage (Swarts et al., *Mol Cell* 2017, 66:221-233 e224).

Cas endonucleases and effector proteins can be used for targeted genome editing (via simplex and multiplex double-strand breaks and nicks) and targeted genome regulation (via tethering of epigenetic effector domains to either the Cas protein or sgRNA. A Cas endonuclease can also be engineered to function as an RNA-guided recombinase, and via RNA tethers could serve as a scaffold for the assembly of multiprotein and nucleic acid complexes (Mali et al., 2013, *Nature Methods* Vol. 10:957-963).

Cas-alpha Endonucleases

A Cas-alpha endonuclease is defined as a functional RNA-guided, PAM-dependent dsDNA cleavage protein of fewer than 800 amino acids, comprising: a C-terminal RuvC catalytic domain split into three subdomains and further comprising bridge-helix and one or more Zinc finger motif (s); and an N-terminal Rec subunit with a helical bundle, WED wedge-like (or "Oligonucleotide Binding Domain", OBD) domain, and, optionally, a Zinc finger motif.

A Cas-alpha endonuclease comprises, when aligned to SEQ ID NO:17, relative to the amino acid position numbers of SEQ ID NO:17, at least one, at least two, at least three, at least four, at least five, at least six, or seven of the following: a Glycine (G) at position 337, a Glycine (G) at position 341, a Glutamic Acid (E) at position 430, a Leucine (L) at position 432, a Cysteine (C) at position 487, a Cysteine (C) at position 490, a Cysteine (C) at position 507, and/or a Cysteine (C) or Histidine (H) at position 512. A Cas-alpha endonuclease comprises, the following motifs: GxxxG, ExL, $Cx_nC$, $Cx_n(C$ or $H)$ (where n=one or more amino acids).

RuvC domains have been demonstrated in the literature to encompass endonuclease functionality. A Cas-alpha endonuclease may be isolated or identified from a locus that comprises a cas-alpha gene encoding an effector protein, and an array comprising a plurality repeats. In some aspects, a cas-alpha locus may further comprise a partial or whole cas1 gene, a cas2 gene, and/or a cas4 gene.

Zinc finger motifs are domains that coordinate one or more zinc ions, usually through Cysteine and Histidine sidechains, to stabilize their fold. Zinc fingers are named for the pattern of Cysteine and Histidine residues that coordinate the zinc ion (e.g., C4 means a zinc ion is coordinated by four Cysteine residues; C3H means a zinc ion is coordinated by three Cysteine residues and one Histidine residue).

Cas-alpha proteins comprise one or more Zinc Finger (ZFN) coordination motif(s) that may form a Zinc binding domain. Zinc Finger-like motifs can aid in target and non-target strand separation and loading of the guide RNA into the DNA target. Cas-alpha proteins comprising one or more Zinc Finger motifs may provide additional stability to the ribonucleoprotein complex on the target polynucleotide. Cas-alpha proteins comprise C4 or C3H zinc binding domains.

Some Cas-alpha proteins and polynucleotides are given in FIGS. 7A-7K, with key structural motifs of the endonuclease proteins depicted in FIGS. 8A-8K, respectively.

Cas-alpha endonucleases are RNA-guided endonucleases capable of binding to, and cleaving, a double-strand DNA target that comprises: (1) a sequence sharing homology with a nucleotide sequence of the guide RNA, and (2) a PAM sequence. In some aspects, the PAM is T-rich. In some aspects, the PAM is C-rich.

A Cas-alpha endonuclease is functional as a double-strand-break-inducing agent, and may also be a nickase, or a single-strand-break inducing agent. In some aspects, a catalytically inactive Cas-alpha endonuclease may be used to target or recruit to a target DNA sequence but not induce cleavage. In some aspects, a catalytically inactive Cas-alpha protein may be used with a functional endonuclease, to cleave a target sequence. In some aspects, a catalytically inactive Cas-alpha protein may be combined with a base editing molecule, such as a deaminase. In some aspects, a deaminase may be a cytidine deaminase. In some aspects, a deaminase may be an adenine deaminase. In some aspects, a deaminase may be ADAR-2.

A Cas-alpha endonuclease is further defined as an RNA-guided double-strand DNA cleavage protein that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, or greater than 500 contiguous amino acids of any of SEQ ID NOs: 17, 18, 19, 20, 32, 33, 34, 35, 36, 37, 38, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, and 371, or a functional fragment thereof, or functional variant thereof that retains at least partial activity. A "functional fragment" of a Cas-alpha endonuclease retains the ability to recognize, or bind, or nick a single strand of a double-stranded polynucleotide, or cleave both strands of a double-stranded polynucleotide, or any combination of the preceding.

The Cas-alpha endonuclease may be encoded by a polynucleotide that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, between 500 and 550, at least 600, between 600 and 650, at least 650, between 650 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or even greater than 1000 contiguous nucleotides of any of SEQ ID NOs: 13, 14, 15, 16, 25, 26, 27, 28, 29, 30, or 31, or encodes any one of SEQ ID NOs: 17, 18, 19, 20, 32, 33, 34, 35, 36, 37, 38, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, and 371.

A Cas endonuclease, effector protein, or functional fragment thereof, for use in the disclosed methods, can be isolated from a native source, or from, a recombinant source where the genetically modified host cell is modified to express the nucleic acid sequence encoding the protein. Alternatively, the Cas protein can be produced using cell free protein expression systems, or be synthetically produced. Effector Cas nucleases may be isolated and introduced into a heterologous cell, or may be modified from its native form to exhibit a different type or magnitude of activity than what it would exhibit in its native source. Such modifications include but are not limited to: fragments, variants, substitutions, deletions, and insertions.

Fragments and variants of Cas endonucleases and Cas effector proteins can be obtained via methods such as site-directed mutagenesis and synthetic construction. Methods for measuring endonuclease activity are well known in the art such as, but not limiting to, WO2013166113 published 7 Nov. 2013, WO2016186953 published 24 Nov. 2016, and WO2016186946 published 24 Nov. 2016.

The Cas endonuclease can comprise a modified form of the Cas polypeptide. The modified form of the Cas polypeptide can include an amino acid change (e.g., deletion, insertion, or substitution) that reduces the naturally-occurring nuclease activity of the Cas protein. For example, in some instances, the modified form of the Cas protein has less than 50%, less than 40%, less than 30%, less than 20%, less than 10%, less than 5%, or less than 1% of the nuclease activity of the corresponding wild-type Cas polypeptide (US20140068797 published 6 Mar. 2014). In some cases, the modified form of the Cas polypeptide has no substantial nuclease activity and is referred to as catalytically "inactivated Cas" or "deactivated Cas (dCas)." An inactivated Cas/deactivated Cas includes a deactivated Cas endonuclease (dCas). A catalytically inactive Cas effector protein can be fused to a heterologous sequence to induce or modify activity.

A Cas endonuclease can be part of a fusion protein comprising one or more heterologous protein domains (e.g., 1, 2, 3, or more domains in addition to the Cas protein). Such a fusion protein may comprise any additional protein sequence, and optionally a linker sequence between any two domains, such as between Cas and a first heterologous domain. Examples of protein domains that may be fused to a Cas protein herein include, without limitation, epitope tags (e.g., histidine [His], V5, FLAG, influenza hemagglutinin [HA], myc, VSV-G, thioredoxin [Trx]), reporters (e.g., glutathione-5-transferase [GST], horseradish peroxidase [HRP], chloramphenicol acetyltransferase [CAT], beta-galactosidase, beta-glucuronidase [GUS], luciferase, green fluorescent protein [GFP], HcRed, DsRed, cyan fluorescent protein [CFP], yellow fluorescent protein [YFP], blue fluorescent protein [BFP]), and domains having one or more of the following activities: methylase activity, demethylase activity, transcription activation activity (e.g., VP16 or VP64), transcription repression activity, transcription release factor activity, histone modification activity, RNA cleavage activity and nucleic acid binding activity. A Cas protein can also be in fusion with a protein that binds DNA molecules or other molecules, such as maltose binding protein (MBP), S-tag, Lex A DNA binding domain (DBD), GAL4A DNA binding domain, and herpes simplex virus (HSV) VP16.

A catalytically active and/or inactive Cas endonuclease can be fused to a heterologous sequence (US20140068797 published 6 Mar. 2014). Suitable fusion partners include, but are not limited to, a polypeptide that provides an activity that indirectly increases transcription by acting directly on the target DNA or on a polypeptide (e.g., a histone or other DNA-binding protein) associated with the target DNA. Additional suitable fusion partners include, but are not limited to, a polypeptide that provides for methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, or demyristoylation activity. Further suitable fusion partners include, but are not limited to, a polypeptide that directly provides for increased transcription of the target nucleic acid (e.g., a transcription activator or a fragment thereof, a protein or fragment thereof that recruits a transcription activator, a small molecule/drug-responsive transcription regulator, etc.). A partially active or catalytically inactive Cas-alpha endonuclease can also be fused to another protein or domain, for example Clo51 or FokI nuclease, to generate double-strand breaks (Guilinger et al. *Nature Biotechnology*, volume 32, number 6, June 2014).

A catalytically active or inactive Cas protein, such as the Cas-alpha protein described herein, can also be in fusion with a molecule that directs editing of single or multiple bases in a polynucleotide sequence, for example a site-specific deaminase that can change the identity of a nucleotide, for example from C•G to T•A or an A•T to G•C (Gaudelli et al., Programmable base editing of A•T to G•C in genomic DNA without DNA cleavage." Nature (2017); Nishida et al. "Targeted nucleotide editing using hybrid prokaryotic and vertebrate adaptive immune systems." Science 353 (6305) (2016); Komor et al. "Programmable editing of a target base in genomic DNA without double-stranded DNA cleavage." Nature 533 (7603) (2016):420-4. A base editing fusion protein may comprise, for example, an active (double strand break creating), partially active (nickase) or deactivated (catalytically inactive) Cas-alpha endonuclease and a deaminase (such as, but not limited to, a cytidine deaminase, an adenine deaminase, APOBEC1, APOBEC3A, BE2, BE3, BE4, ABEs, or the like). Base edit repair inhibitors and glycosylase inhibitors (e.g., uracil glycosylase inhibitor (to prevent uracil removal)) are contemplated as other components of a base editing system, in some embodiments.

The Cas endonucleases described herein can be expressed and purified by methods known in the art, for example as described in WO/2016/186953 published 24 Nov. 2016.

Many Cas endonucleases have been described to date that can recognize specific PAM sequences (WO2016186953 published 24 Nov. 2016, WO2016186946 published 24 Nov. 2016, and Zetsche B et al. 2015. Cell 163, 1013) and cleave the target DNA at a specific position. It is understood that based on the methods and embodiments described herein utilizing a novel guided Cas system one skilled in the art can now tailor these methods such that they can utilize any guided endonuclease system.

A Cas effector protein can comprise a heterologous nuclear localization sequence (NLS). A heterologous NLS amino acid sequence herein may be of sufficient strength to drive accumulation of a Cas protein in a detectable amount in the nucleus of a yeast cell herein, for example. An NLS may comprise one (monopartite) or more (e.g., bipartite) short sequences (e.g., 2 to 20 residues) of basic, positively charged residues (e.g., lysine and/or arginine), and can be located anywhere in a Cas amino acid sequence but such that it is exposed on the protein surface. An NLS may be operably linked to the N-terminus or C-terminus of a Cas protein herein, for example. Two or more NLS sequences can be linked to a Cas protein, for example, such as on both the N- and C-termini of a Cas protein. The Cas endonuclease gene can be operably linked to a SV40 nuclear targeting signal upstream of the Cas codon region and a bipartite VirD2 nuclear localization signal (Tinland et al. (1992) *Proc. Natl. Acad. Sci. USA* 89:7442-6) downstream of the Cas codon region. Non-limiting examples of suitable NLS sequences herein include those disclosed in U.S. Pat. Nos. 6,660,830 and 7,309,576.

Guide Polynucleotides

The guide polynucleotide enables target recognition, binding, and optionally cleavage by the Cas endonuclease, and can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide RNA" or "gRNA" (US20150082478 published 19 Mar. 2015 and US20150059010 published 26 Feb. 2015). A guide polynucleotide may be engineered or synthetic.

The guide polynucleotide includes a chimeric non-naturally occurring guide RNA comprising regions that are not found together in nature (i.e., they are heterologous with each other). For example, a chimeric non-naturally occurring guide RNA comprising a first nucleotide sequence domain (referred to as Variable Targeting domain or VT domain) that can hybridize to a nucleotide sequence in a target DNA, linked to a second nucleotide sequence that can recognize the Cas endonuclease, such that the first and second nucleotide sequence are not found linked together in nature.

The guide polynucleotide can be a double molecule (also referred to as duplex guide polynucleotide) comprising a crNucleotide sequence (such as a crRNA) and a tracrNucleotide (such as a tracrRNA) sequence. In some cases, there is a linker polynucleotide that connects the crRNA and tracrRNA to form a single guide, for example an sgRNA.

The crNucleotide includes a first nucleotide sequence domain (referred to as Variable Targeting domain or VT domain) that can hybridize to a nucleotide sequence in a target DNA and a second nucleotide sequence (also referred to as a tracr mate sequence) that is part of a Cas endonuclease recognition (CER) domain. The tracr mate sequence can hybridized to a tracrNucleotide along a region of complementarity and together form the Cas endonuclease recognition domain or CER domain. The CER domain is capable of interacting with a Cas endonuclease polypeptide. The crNucleotide and the tracrNucleotide of the duplex guide polynucleotide can be RNA, DNA, and/or RNA-DNA-combination sequences. In some embodiments, the crNucleotide molecule of the duplex guide polynucleotide is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the crRNA naturally occurring in Bacteria and Archaea. The size of the fragment of the crRNA naturally occurring in Bacteria and Archaea that can be present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides. In some embodiments, a crRNA molecule is selected from the group consisting of: SEQ ID NOs: 57, 58, and 59.

In some embodiments the tracrNucleotide is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides. In one embodiment, the RNA that guides the RNA/Cas9 endonuclease complex is a duplexed RNA comprising a duplex crRNA-tracrRNA. The tracrRNA (trans-activating CRISPR RNA) comprises, in the 5'-to-3' direction, (i) a sequence that anneals with the repeat region of CRISPR type II crRNA and (ii) a stem loop-comprising portion (Deltcheva et al., *Nature* 471:602-607). The duplex guide polynucleotide can form a complex with a Cas endonuclease, wherein said guide polynucleotide/Cas endonuclease complex (also referred to as a guide polynucleotide/Cas endonuclease system) can direct the Cas endonuclease to a genomic target site, enabling the Cas endonuclease to recognize, bind to, and optionally nick or cleave (introduce a single or double-strand break) into the target site. (US20150082478 published 19 Mar. 2015 and US20150059010 published 26 Feb. 2015).

In some embodiments, a tracrRNA molecule is selected from the group consisting of: SEQ ID NOs: 60-68.

In one aspect, the guide polynucleotide is a guide polynucleotide capable of forming a PGEN as described herein, wherein said guide polynucleotide comprises a first nucleotide sequence domain that is complementary to a nucleotide sequence in a target DNA, and a second nucleotide sequence domain that interacts with said Cas endonuclease polypeptide.

In one aspect, the guide polynucleotide is a guide polynucleotide described herein, wherein the first nucleotide sequence and the second nucleotide sequence domain is selected from the group consisting of a DNA sequence, a RNA sequence, and a combination thereof.

In one aspect, the guide polynucleotide is a guide polynucleotide described herein, wherein the first nucleotide sequence and the second nucleotide sequence domain is selected from the group consisting of RNA backbone modifications that enhance stability, DNA backbone modifications that enhance stability, and a combination thereof (see Kanasty et al., 2013, Common RNA-backbone modifications, *Nature Materials* 12:976-977; US20150082478 published 19 Mar. 2015 and US20150059010 published 26 Feb. 2015)

The guide RNA includes a dual molecule comprising a chimeric non-naturally occurring crRNA linked to at least one tracrRNA. A chimeric non-naturally occurring crRNA includes a crRNA that comprises regions that are not found together in nature (i.e., they are heterologous with each other. For example, a crRNA comprising a first nucleotide sequence domain (referred to as Variable Targeting domain or VT domain) that can hybridize to a nucleotide sequence in a target DNA, linked to a second nucleotide sequence (also referred to as a tracr mate sequence) such that the first and second sequence are not found linked together in nature.

The guide polynucleotide can also be a single molecule (also referred to as single guide polynucleotide) comprising a crNucleotide sequence linked to a tracrNucleotide sequence. The single guide polynucleotide comprises a first nucleotide sequence domain (referred to as Variable Targeting domain or VT domain) that can hybridize to a nucleotide sequence in a target DNA and a Cas endonuclease recognition domain (CER domain), that interacts with a Cas endonuclease polypeptide. In some embodiments, an sgRNA molecule is selected from the group consisting of: SEQ ID NOs: 69-77.

The VT domain and/or the CER domain of a single guide polynucleotide can comprise a RNA sequence, a DNA sequence, or a RNA-DNA-combination sequence. The single guide polynucleotide being comprised of sequences from the crNucleotide and the tracrNucleotide may be referred to as "single guide RNA" (when composed of a contiguous stretch of RNA nucleotides) or "single guide DNA" (when composed of a contiguous stretch of DNA nucleotides) or "single guide RNA-DNA" (when composed of a combination of RNA and DNA nucleotides). The single guide polynucleotide can form a complex with a Cas endonuclease, wherein said guide polynucleotide/Cas endonuclease complex (also referred to as a guide polynucleotide/Cas endonuclease system) can direct the Cas endonuclease to a genomic target site, enabling the Cas endonuclease to recognize, bind to, and optionally nick or cleave (introduce a single or double-strand break) the target site. (US20150082478 published 19 Mar. 2015 and US20150059010 published 26 Feb. 2015).

A chimeric non-naturally occurring single guide RNA (sgRNA) includes a sgRNA that comprises regions that are not found together in nature (i.e., they are heterologous with each other. For example, a sgRNA comprising a first nucleotide sequence domain (referred to as Variable Targeting domain or VT domain) that can hybridize to a nucleotide sequence in a target DNA linked to a second nucleotide sequence (also referred to as a tracr mate sequence) that are not found linked together in nature.

The nucleotide sequence linking the crNucleotide and the tracrNucleotide of a single guide polynucleotide can comprise a RNA sequence, a DNA sequence, or a RNA-DNA combination sequence. In one embodiment, the nucleotide sequence linking the crNucleotide and the tracrNucleotide of a single guide polynucleotide (also referred to as "loop") can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another embodiment, the nucleotide sequence linking the crNucleotide and the tracrNucleotide of a single guide polynucleotide can comprise a tetraloop sequence, such as, but not limiting to a GAAA tetraloop sequence.

The guide polynucleotide can be produced by any method known in the art, including chemically synthesizing guide polynucleotides (such as but not limiting to Hendel et al. 2015, *Nature Biotechnology* 33, 985-989), in vitro generated guide polynucleotides, and/or self-splicing guide RNAs (such as but not limited to Xie et al. 2015, *PNAS* 112:3570-3575).

Protospacer Adjacent Motif (PAM)

A "protospacer adjacent motif" (PAM) herein refers to a short nucleotide sequence adjacent to a target sequence (protospacer) that can be recognized (targeted) by a guide polynucleotide/Cas endonuclease system. The Cas endonuclease may not successfully recognize a target DNA sequence if the target DNA sequence is not followed by a PAM sequence. The sequence and length of a PAM herein can differ depending on the Cas protein or Cas protein complex used. The PAM sequence can be of any length but is typically 1, 2, 3, 4, 5, 6, 7, 8, 9, 10, 11, 12, 13, 14, 15, 16, 17, 18, 19 or 20 nucleotides long.

A "randomized PAM" and "randomized protospacer adjacent motif" are used interchangeably herein, and refer to a random DNA sequence adjacent to a target sequence (protospacer) that is recognized (targeted) by a guide polynucleotide/Cas endonuclease system. The randomized PAM sequence can be of any length but is typically 1, 2, 3, 4, 5, 6, 7, 8, 9, 10, 11, 12, 13, 14, 15, 16, 17, 18, 19 or 20 nucleotides long. A randomized nucleotide includes anyone of the nucleotides A, C, G or T.

Guide Polynucleotide/Cas Endonuclease Complexes

A guide polynucleotide/Cas endonuclease complex described herein is capable of recognizing, binding to, and optionally nicking, unwinding, or cleaving all or part of a target sequence.

A guide polynucleotide/Cas endonuclease complex that can cleave both strands of a DNA target sequence typically comprises a Cas protein that has all of its endonuclease domains in a functional state (e.g., wild type endonuclease domains or variants thereof retaining some or all activity in each endonuclease domain). Thus, a wild type Cas protein (e.g., a Cas protein disclosed herein), or a variant thereof retaining some or all activity in each endonuclease domain of the Cas protein, is a suitable example of a Cas endonuclease that can cleave both strands of a DNA target sequence.

A guide polynucleotide/Cas endonuclease complex that can cleave one strand of a DNA target sequence can be characterized herein as having nickase activity (e.g., partial cleaving capability). A Cas nickase typically comprises one functional endonuclease domain that allows the Cas to cleave only one strand (i.e., make a nick) of a DNA target sequence. For example, a Cas9 nickase may comprise (i) a mutant, dysfunctional RuvC domain and (ii) a functional HNH domain (e.g., wild type HNH domain). As another example, a Cas9 nickase may comprise (i) a functional RuvC domain (e.g., wild type RuvC domain) and (ii) a mutant, dysfunctional HNH domain. Non-limiting examples of Cas9 nickases suitable for use herein are disclosed in US20140189896 published on 3 Jul. 2014. A pair of Cas nickases can be used to increase the specificity of DNA targeting. In general, this can be done by providing two Cas nickases that, by virtue of being associated with RNA components with different guide sequences, target and nick nearby DNA sequences on opposite strands in the region for desired targeting. Such nearby cleavage of each DNA strand creates a double-strand break (i.e., a DSB with single-stranded overhangs), which is then recognized as a substrate for non-homologous-end-joining, NHEJ (prone to imperfect repair leading to mutations) or homologous recombination, HR. Each nick in these embodiments can be at least about 5, between 5 and 10, at least 10, between 10 and 15, at least 15, between 15 and 20, at least 20, between 20 and 30, at least 30, between 30 and 40, at least 40, between 40 and 50, at least 50, between 50 and 60, at least 60, between 60 and 70, at least 70, between 70 and 80, at least 80, between 80 and 90, at least 90, between 90 and 100, or 100 or greater (or any integer between 5 and 100) bases apart from each other, for example. One or two Cas nickase proteins herein can be used in a Cas nickase pair. For example, a Cas9 nickase with a mutant RuvC domain, but functioning HNH domain (i.e., Cas9 HNH+/RuvC−), can be used (e.g., *Streptococcus pyogenes* Cas9 HNH+/RuvC−). Each Cas9 nickase (e.g., Cas9 HNH+/RuvC−) can be directed to specific DNA sites nearby each other (up to 100 base pairs apart) by using suitable RNA components herein with guide RNA sequences targeting each nickase to each specific DNA site.

A guide polynucleotide/Cas endonuclease complex in certain embodiments can bind to a DNA target site sequence, but does not cleave any strand at the target site sequence. Such a complex may comprise a Cas protein in which all of its nuclease domains are mutant, dysfunctional. For example, a Cas9 protein that can bind to a DNA target site sequence, but does not cleave any strand at the target site sequence, may comprise both a mutant, dysfunctional RuvC domain and a mutant, dysfunctional HNH domain. A Cas protein herein that binds, but does not cleave, a target DNA sequence can be used to modulate gene expression, for example, in which case the Cas protein could be fused with a transcription factor (or portion thereof) (e.g., a repressor or activator, such as any of those disclosed herein).

In one aspect, the guide polynucleotide/Cas endonuclease complex (PGEN) described herein is a PGEN, wherein said Cas endonuclease is optionally covalently or non-covalently linked, or assembled to at least one protein subunit, or functional fragment thereof.

In one embodiment of the disclosure, the guide polynucleotide/Cas endonuclease complex is a guide polynucleotide/Cas endonuclease complex (PGEN) comprising at least one guide polynucleotide and at least one Cas endonuclease polypeptide, wherein said Cas endonuclease polypeptide comprises at least one protein subunit, or a functional fragment thereof, wherein said guide polynucleotide is a chimeric non-naturally occurring guide polynucleotide, wherein said guide polynucleotide/Cas endonuclease complex is capable of recognizing, binding to, and optionally nicking, unwinding, or cleaving all or part of a target sequence.

The Cas effector protein can be a Cas-alpha effector protein as disclosed herein.

In one embodiment of the disclosure, the guide polynucleotide/Cas effector complex is a guide polynucleotide/Cas effector protein complex (PGEN) comprising at least one guide polynucleotide and a Cas-alpha effector protein, wherein said guide polynucleotide/Cas effector protein complex is capable of recognizing, binding to, and optionally nicking, unwinding, or cleaving all or part of a target sequence.

The PGEN can be a guide polynucleotide/Cas effector protein complex, wherein said Cas effector protein further comprises one copy or multiple copies of at least one protein subunit, or a functional fragment thereof. In some embodiments, said protein subunit is selected from the group consisting of a Cas1 protein subunit, a Cas2 protein subunit, a Cas4 protein subunit, and any combination thereof. The PGEN can be a guide polynucleotide/Cas effector protein complex, wherein said Cas effector protein further comprises at least two different protein subunits of selected from the group consisting of a Cas1, Cas2, and Cas4.

The PGEN can be a guide polynucleotide/Cas effector protein complex, wherein said Cas effector protein further comprises at least three different protein subunits, or functional fragments thereof, selected from the group consisting of Cas1, Cas2, and one additional Cas protein, optionally comprising Cas4.

In one aspect, the guide polynucleotide/Cas effector protein complex (PGEN) described herein is a PGEN, wherein said Cas effector protein is covalently or non-covalently linked to at least one protein subunit, or functional fragment thereof. The PGEN can be a guide polynucleotide/Cas effector protein complex, wherein said Cas effector protein polypeptide is covalently or non-covalently linked, or assembled to one copy or multiple copies of at least one protein subunit, or a functional fragment thereof, selected from the group consisting of a Cas1 protein subunit, a Cas2 protein subunit, a one additional Cas protein optionally comprising Cas4 protein subunit, and any combination thereof. The PGEN can be a guide polynucleotide/Cas effector protein complex, wherein said Cas effector protein is covalently or non-covalently linked or assembled to at least two different protein subunits selected from the group consisting of a Cas1, a Cas2, and one additional Cas protein, optionally comprising Cas4. The PGEN can be a guide polynucleotide/Cas effector protein complex, wherein said Cas effector protein is covalently or non-covalently linked to at least three different protein subunits, or functional fragments thereof, selected from the group consisting of a Cas1, a Cas2, and one additional Cas protein, optionally comprising Cas4, and any combination thereof.

Any component of the guide polynucleotide/Cas effector protein complex, the guide polynucleotide/Cas effector protein complex itself, as well as the polynucleotide modification template(s) and/or donor DNA(s), can be introduced into a heterologous cell or organism by any method known in the art.

Recombinant Constructs for Transformation of Cells

The disclosed guide polynucleotides, Cas endonucleases, polynucleotide modification templates, donor DNAs, guide polynucleotide/Cas endonuclease systems disclosed herein, and any one combination thereof, optionally further comprising one or more polynucleotide(s) of interest, can be introduced into a cell. Cells include, but are not limited to, human, non-human, animal, bacterial, fungal, insect, yeast, non-conventional yeast, and plant cells as well as plants and seeds produced by the methods described herein.

Standard recombinant DNA and molecular cloning techniques used herein are well known in the art and are described more fully in Sambrook et al., *Molecular Cloning: A Laboratory Manual; Cold Spring Harbor Laboratory*: Cold Spring Harbor, N.Y. (1989). Transformation methods are well known to those skilled in the art and are described infra.

Vectors and constructs include circular plasmids, and linear polynucleotides, comprising a polynucleotide of interest and optionally other components including linkers, adapters, regulatory or analysis. In some examples a recognition site and/or target site can be comprised within an intron, coding sequence, 5' UTRs, 3' UTRs, and/or regulatory regions.

Components for Expression and Utilization of Novel CRISPR-Cas Systems in Prokaryotic and Eukaryotic Cells The invention further provides expression constructs for expressing in a prokaryotic or eukaryotic cell/organism a guide RNA/Cas system that is capable of recognizing, binding to, and optionally nicking, unwinding, or cleaving all or part of a target sequence.

In one embodiment, the expression constructs of the disclosure comprise a promoter operably linked to a nucleotide sequence encoding a Cas gene (or plant optimized, including a Cas endonuclease gene described herein) and a promoter operably linked to a guide RNA of the present disclosure. The promoter is capable of driving expression of an operably linked nucleotide sequence in a prokaryotic or eukaryotic cell/organism.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

A method of expressing RNA components such as gRNA in eukaryotic cells for performing Cas9-mediated DNA targeting has been to use RNA polymerase III (Pol III) promoters, which allow for transcription of RNA with precisely defined, unmodified, 5'- and 3'-ends (DiCarlo et al., *Nucleic Acids Res.* 41:4336-4343; Ma et al., *Mol. Ther. Nucleic Acids* 3:e161). This strategy has been successfully applied in cells of several different species including maize and soybean (US20150082478 published 19 Mar. 2015). Methods for expressing RNA components that do not have a 5' cap have been described (WO2016/025131 published 18 Feb. 2016).

Various methods and compositions can be employed to obtain a cell or organism having a polynucleotide of interest inserted in a target site for a Cas endonuclease. Such methods can employ homologous recombination (HR) to provide integration of the polynucleotide of interest at the target site. In one method described herein, a polynucleotide of interest is introduced into the organism cell via a donor DNA construct.

The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods* Vol. 10:957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity at least of about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, between 98% and 99%, 99%, between 99% and 100%, or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) *Current Protocols*, (Greene Publishing Associates, Inc. and John Wiley & Sons, Inc.); and, Tijssen (1993) *Laboratory Techniques in Biochemistry and Molecular Biology—Hybridization with Nucleic Acid Probes*, (Elsevier, New York).

The structural similarity between a given genomic region and the corresponding region of homology found on the donor DNA can be any degree of sequence identity that allows for homologous recombination to occur. For example, the amount of homology or sequence identity shared by the "region of homology" of the donor DNA and the "genomic region" of the organism genome can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination The region of homology on the donor DNA can have homology to any sequence flanking the target site. While in some instances the regions of homology share significant sequence homology to the genomic sequence immediately flanking the target site, it is recognized that the regions of homology can be designed to have sufficient homology to regions that may be further 5' or 3' to the target site. The regions of homology can also have homology with a fragment of the target site along with downstream genomic regions In one embodiment, the first region of homology further comprises a first fragment of the target site and the second region of homology comprises a second fragment of the target site, wherein the first and second fragments are dissimilar.

Polynucleotides of Interest

Polynucleotides of interest are further described herein and include polynucleotides reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for genetic engineering will change accordingly.

General categories of polynucleotides of interest include, for example, genes of interest involved in information, such as zinc fingers, those involved in communication, such as kinases, and those involved in housekeeping, such as heat shock proteins. More specific polynucleotides of interest include, but are not limited to, genes involved in traits of agronomic interest such as but not limited to: crop yield, grain quality, crop nutrient content, starch and carbohydrate quality and quantity as well as those affecting kernel size, sucrose loading, protein quality and quantity, nitrogen fixation and/or utilization, fatty acid and oil composition, genes encoding proteins conferring resistance to abiotic stress (such as drought, nitrogen, temperature, salinity, toxic metals or trace elements, or those conferring resistance to toxins such as pesticides and herbicides), genes encoding proteins conferring resistance to biotic stress (such as attacks by fungi, viruses, bacteria, insects, and nematodes, and development of diseases associated with these organisms).

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389.

Polynucleotide sequences of interest may encode proteins involved in providing disease or pest resistance. By "disease resistance" or "pest resistance" is intended that the plants avoid the harmful symptoms that are the outcome of the plant-pathogen interactions. Pest resistance genes may encode resistance to pests that have great yield drag such as rootworm, cutworm, European Corn Borer, and the like. Disease resistance and insect resistance genes such as lysozymes or cecropins for antibacterial protection, or proteins such as defensins, glucanases or chitinases for antifungal protection, or *Bacillus thuringiensis* endotoxins, protease inhibitors, collagenases, lectins, or glycosidases for controlling nematodes or insects are all examples of useful gene products. Genes encoding disease resistance traits include detoxification genes, such as against fumonisin (U.S. Pat. No. 5,792,931); avirulence (avr) and disease resistance (R) genes (Jones et al. (1994) *Science* 266:789; Martin et al. (1993) *Science* 262:1432; and Mindrinos et al. (1994) *Cell* 78:1089; and the like. Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser et al. (1986) *Gene* 48:109); and the like.

An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of acetolactate synthase (ALS, also referred to as acetohydroxyacid synthase, AHAS), in particular the sulfonylurea (UK:sulphonylurea) type herbicides, genes coding for resistance to herbicides that act to inhibit the action of glutamine synthase, such as phosphinothricin or basta (e.g., the bar gene), glyphosate (e.g., the EPSP synthase gene and the GAT gene), HPPD inhibitors (e.g, the HPPD gene) or other such genes known in the art. See, for example, U.S. Pat. Nos. 7,626,077, 5,310,667, 5,866,775, 6,225,114, 6,248,876, 7,169,970, 6,867,293, and 9,187,762. The bar gene encodes resistance to the herbicide basta, the nptII gene encodes resistance to the antibiotics kanamycin and geneticin, and the ALS-gene mutants encode resistance to the herbicide chlorsulfuron.

Furthermore, it is recognized that the polynucleotide of interest may also comprise antisense sequences complementary to at least a portion of the messenger RNA (mRNA) for a targeted gene sequence of interest. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, 80%, or 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides, or greater may be used.

In addition, the polynucleotide of interest may also be used in the sense orientation to suppress the expression of endogenous genes in plants. Methods for suppressing gene expression in plants using polynucleotides in the sense orientation are known in the art. The methods generally involve transforming plants with a DNA construct comprising a promoter that drives expression in a plant operably linked to at least a portion of a nucleotide sequence that corresponds to the transcript of the endogenous gene. Typically, such a nucleotide sequence has substantial sequence identity to the sequence of the transcript of the endogenous gene, generally greater than about 65% sequence identity, about 85% sequence identity, or greater than about 95% sequence identity. See U.S. Pat. Nos. 5,283,184 and 5,034,323.

The polynucleotide of interest can also be a phenotypic marker. A phenotypic marker is screenable or a selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that comprises it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as sulphonylureas, glufosinate ammonium, bromoxynil, imidazolinones, and 2,4-dichlorophenoxyacetate (2,4-D). See for example, Acetolactase synthase (ALS) for resistance to sulfonylureas, imidazolinones, triazolopyrimidine sulfonamides, pyrimidinylsalicylates and sulphonylaminocarbonyl-triazolinones (Shaner and Singh, 1997, *Herbicide Activity: Toxicol Biochem Mol Biol* 69-110); glyphosate resistant 5-enolpyruvylshikimate-3-phosphate (EPSPS) (Saroha et al. 1998, *J. Plant Biochemistry & Biotechnology* Vol 7:65-72);

Polynucleotides of interest includes genes that can be stacked or used in combination with other traits, such as but not limited to herbicide resistance or any other trait described herein. Polynucleotides of interest and/or traits can be stacked together in a complex trait locus as described in US20130263324 published 3 Oct. 2013 and in WO/2013/112686, published 1 Aug. 2013.

A polypeptide of interest includes any protein or polypeptide that is encoded by a polynucleotide of interest described herein.

Further provided are methods for identifying at least one plant cell, comprising in its genome, a polynucleotide of interest integrated at the target site. A variety of methods are available for identifying those plant cells with insertion into the genome at or near to the target site. Such methods can be viewed as directly analyzing a target sequence to detect any change in the target sequence, including but not limited to PCR methods, sequencing methods, nuclease digestion, Southern blots, and any combination thereof. See, for example, US20090133152 published 21 May 2009. The method also comprises recovering a plant from the plant cell comprising a polynucleotide of interest integrated into its genome. The plant may be sterile or fertile. It is recognized that any polynucleotide of interest can be provided, integrated into the plant genome at the target site, and expressed in a plant.

Optimization of Sequences for Expression in Plants

Methods are available in the art for synthesizing plant-preferred genes. See, for example, U.S. Pat. Nos. 5,380,831, and 5,436,391, and Murray et al. (1989) *Nucleic Acids Res.* 17:477-498. Additional sequence modifications are known to enhance gene expression in a plant host. These include, for example, elimination of: one or more sequences encoding spurious polyadenylation signals, one or more exon-intron splice site signals, one or more transposon-like repeats, and other such well-characterized sequences that may be deleterious to gene expression. The G-C content of the sequence may be adjusted to levels average for a given plant host, as calculated by reference to known genes expressed in the host plant cell. When possible, the sequence is modified to avoid one or more predicted hairpin secondary mRNA structures. Thus, "a plant-optimized nucleotide sequence" of the present disclosure comprises one or more of such sequence modifications.

Expression Elements

Any polynucleotide encoding a Cas protein or other CRISPR system component disclosed herein may be functionally linked to a heterologous expression element, to facilitate transcription or regulation in a host cell. Such expression elements include but are not limited to: promoter, leader, intron, and terminator. Expression elements may be "minimal"—meaning a shorter sequence derived from a native source, that still functions as an expression regulator or modifier. Alternatively, an expression element may be "optimized"—meaning that its polynucleotide sequence has been altered from its native state in order to function with a more desirable characteristic in a particular host cell (for example, but not limited to, a bacterial promoter may be "maize-optimized" to improve its expression in corn plants). Alternatively, an expression element may be "synthetic"—meaning that it is designed in silico and synthesized for use in a host cell. Synthetic expression elements may be entirely synthetic, or partially synthetic (comprising a fragment of a naturally-occurring polynucleotide sequence).

It has been shown that certain promoters are able to direct RNA synthesis at a higher rate than others. These are called "strong promoters". Certain other promoters have been shown to direct RNA synthesis at higher levels only in particular types of cells or tissues and are often referred to as "tissue specific promoters", or "tissue-preferred promoters" if the promoters direct RNA synthesis preferably in certain tissues but also in other tissues at reduced levels.

A plant promoter includes a promoter capable of initiating transcription in a plant cell. For a review of plant promoters, see, Potenza et al., 2004, *In vitro Cell Dev Biol* 40:1-22; Porto et al., 2014, Molecular Biotechnology (2014), 56(1), 38-49.

Constitutive promoters include, for example, the core CaMV 35S promoter (Odell et al., (1985) *Nature* 313:810-2); rice actin (McElroy et al., (1990) *Plant Cell* 2:163-71); ubiquitin (Christensen et al., (1989) *Plant Mol Biol* 12:619-32; ALS promoter (U.S. Pat. No. 5,659,026) and the like.

Tissue-preferred promoters can be utilized to target enhanced expression within a particular plant tissue. Tissue-preferred promoters include, for example, WO2013103367 published 11 Jul. 2013, Kawamata et al., (1997) *Plant Cell Physiol* 38:792-803; Hansen et al., (1997) *Mol Gen Genet* 254:337-43; Russell et al., (1997) *Transgenic Res* 6:157-68; Rinehart et al., (1996) *Plant Physiol* 112:1331-41; Van Camp et al., (1996) *Plant Physiol* 112:525-35; Canevascini et al., (1996) *Plant Physiol* 112:513-524; Lam, (1994) *Results Probl Cell Differ* 20:181-96; and Guevara-Garcia et al., (1993) *Plant J* 4:495-505. Leaf-preferred promoters include, for example, Yamamoto et al., (1997) *Plant J* 12:255-65; Kwon et al., (1994) *Plant Physiol* 105:357-67; Yamamoto et al., (1994) *Plant Cell Physiol* 35:773-8; Gotor et al., (1993) *Plant J* 3:509-18; Orozco et al., (1993) *Plant Mol Biol* 23:1129-38; Matsuoka et al., (1993) *Proc. Natl. Acad. Sci. USA* 90:9586-90; Simpson et al., (1958) *EMBO J* 4:2723-9; Timko et al., (1988) *Nature* 318:57-8. Root-preferred promoters include, for example, Hire et al., (1992) *Plant Mol Biol* 20:207-18 (soybean root-specific glutamine synthase gene); Miao et al., (1991) *Plant Cell* 3:11-22 (cytosolic glutamine synthase (GS)); Keller and Baumgartner, (1991) *Plant Cell* 3:1051-61 (root-specific control element in the GRP 1.8 gene of French bean); Sanger et al., (1990) *Plant Mol Biol* 14:433-43 (root-specific promoter of *A. tumefaciens* mannopine synthase (MAS)); Bogusz et al., (1990) *Plant Cell* 2:633-41 (root-specific promoters isolated from *Parasponia andersonii* and *Trema tomentosa*); Leach and Aoyagi, (1991) *Plant Sci* 79:69-76 (*A. rhizogenes* rolC and rolD root-inducing genes); Teeri et al., (1989) *EMBO J* 8:343-50 (*Agrobacterium* wound-induced TR1' and TR2' genes); VfENOD-GRP3 gene promoter (Kuster et al., (1995) *Plant Mol Biol* 29:759-72); and rolB promoter (Capana et al., (1994) *Plant Mol Biol* 25:681-91; phaseolin gene (Murai et al., (1983) *Science* 23:476-82; Sengopta-Gopalen et al., (1988) *Proc. Natl. Acad. Sci. USA* 82:3320-4). See also, U.S. Pat. Nos. 5,837,876; 5,750,386; 5,633,363; 5,459,252; 5,401,836; 5,110,732 and 5,023,179.

Seed-preferred promoters include both seed-specific promoters active during seed development, as well as seed-germinating promoters active during seed germination. See, Thompson et al., (1989) *BioEssays* 10:108. Seed-preferred promoters include, but are not limited to, Cim1 (cytokinin-induced message); cZ19B1 (maize 19 kDa zein); and milps (myo-inositol-1-phosphate synthase); and for example those disclosed in WO2000011177 published 2 Mar. 2000 and U.S. Pat. No. 6,225,529. For dicots, seed-preferred promoters include, but are not limited to, bean β-phaseolin, napin, β-conglycinin, soybean lectin, cruciferin, and the like. For monocots, seed-preferred promoters include, but are not limited to, maize 15 kDa zein, 22 kDa zein, 27 kDa gamma zein, waxy, shrunken 1, shrunken 2, globulin 1, oleosin, and nuc1. See also, WO2000012733 published 9 Mar. 2000, where seed-preferred promoters from END1 and END2 genes are disclosed.

Chemical inducible (regulated) promoters can be used to modulate the expression of a gene in a prokaryotic and eukaryotic cell or organism through the application of an exogenous chemical regulator. The promoter may be a chemical-inducible promoter, where application of the chemical induces gene expression, or a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) *Plant Cell Physiol* 38:568-77), the maize GST promoter (GST-II-27, WO1993001294 published 21 Jan. 1993), activated by hydrophobic electrophilic compounds used as pre-emergent herbicides, and the tobacco PR-la promoter (Ono et al., (2004) *Biosci Biotechnol Biochem* 68:803-7) activated by salicylic acid. Other chemical-regulated promoters include steroid-responsive promoters (see, for example, the glucocorticoid-inducible promoter (Schena et al., (1991) *Proc. Natl. Acad. Sci. USA* 88:10421-5; McNellis et al., (1998) *Plant J* 14:247-257); tetracycline-inducible and tetracycline-repressible promoters (Gatz et al., (1991) *Mol Gen Genet* 227:229-37; U.S. Pat. Nos. 5,814,618 and 5,789,156).

Pathogen inducible promoters induced following infection by a pathogen include, but are not limited to those regulating expression of PR proteins, SAR proteins, beta-1,3-glucanase, chitinase, etc.

A stress-inducible promoter includes the RD29A promoter (Kasuga et al. (1999) Nature Biotechnol. 17:287-91). One of ordinary skill in the art is familiar with protocols for simulating stress conditions such as drought, osmotic stress, salt stress and temperature stress and for evaluating stress tolerance of plants that have been subjected to simulated or naturally-occurring stress conditions.

Another example of an inducible promoter useful in plant cells, is the ZmCAS1 promoter, described in US20130312137 published 21 Nov. 2013.

New promoters of various types useful in plant cells are constantly being discovered; numerous examples may be found in the compilation by Okamuro and Goldberg, (1989) In *The Biochemistry of Plants*, Vol. 115, Stumpf and Conn, eds (New York, N.Y.: Academic Press), pp. 1-82.

Modification of Genomes with Novel CRISPR-Cas System Components

As described herein, a guided Cas endonuclease can recognize, bind to a DNA target sequence and introduce a single strand (nick) or double-strand break. Once a single or double-strand break is induced in the DNA, the cell's DNA repair mechanism is activated to repair the break. Error-prone DNA repair mechanisms can produce mutations at double-strand break sites. The most common repair mechanism to bring the broken ends together is the nonhomologous end-joining (NHEJ) pathway (Bleuyard et al., (2006) *DNA Repair* 5:1-12). The structural integrity of chromosomes is typically preserved by the repair, but deletions, insertions, or other rearrangements (such as chromosomal translocations) are possible (Siebert and Puchta, 2002, *Plant Cell* 14:1121-31; Pacher et al., 2007, *Genetics* 175:21-9).

DNA double-strand breaks appear to be an effective factor to stimulate homologous recombination pathways (Puchta et al., (1995) *Plant Mol Biol* 28:281-92; Tzfira and White, (2005) *Trends Biotechnol* 23:567-9; Puchta, (2005) *J Exp Bot* 56:1-14). Using DNA-breaking agents, a two- to nine-fold increase of homologous recombination was observed between artificially constructed homologous DNA repeats in plants (Puchta et al., (1995) *Plant Mol Biol* 28:281-92). In maize protoplasts, experiments with linear DNA molecules demonstrated enhanced homologous recombination between plasmids (Lyznik et al., (1991) *Mol Gen Genet* 230:209-18).

Homology-directed repair (HDR) is a mechanism in cells to repair double-stranded and single stranded DNA breaks. Homology-directed repair includes homologous recombination (HR) and single-strand annealing (SSA) (Lieber. 2010 *Annu. Rev. Biochem.* 79:181-211). The most common form of HDR is called homologous recombination (HR), which has the longest sequence homology requirements between the donor and acceptor DNA. Other forms of HDR include single-stranded annealing (SSA) and breakage-induced replication, and these require shorter sequence homology relative to HR. Homology-directed repair at nicks (single-stranded breaks) can occur via a mechanism distinct from HDR at double-strand breaks (Davis and Maizels. *PNAS* (0027-8424), 111 (10), p. E924-E932).

Alteration of the genome of a prokaryotic and eukaryotic cell or organism cell, for example, through homologous recombination (HR), is a powerful tool for genetic engineering. Homologous recombination has been demonstrated in plants (Halfter et al., (1992) *Mol Gen Genet* 231:186-93) and insects (Dray and Gloor, 1997, *Genetics* 147:689-99). Homologous recombination has also been accomplished in other organisms. For example, at least 150-200 bp of homology was required for homologous recombination in the parasitic protozoan *Leishmania* (Papadopoulou and Dumas, (1997) *Nucleic Acids Res* 25:4278-86). In the filamentous fungus *Aspergillus nidulans*, gene replacement has been accomplished with as little as 50 bp flanking homology (Chaveroche et al., (2000) *Nucleic Acids Res* 28:e97). Targeted gene replacement has also been demonstrated in the ciliate *Tetrahymena thermophila* (Gaertig et al., (1994) *Nucleic Acids Res* 22:5391-8). In mammals, homologous recombination has been most successful in the mouse using pluripotent embryonic stem cell lines (ES) that can be grown in culture, transformed, selected and introduced into a mouse embryo (Watson et al., 1992, Recombinant DNA, 2nd Ed., Scientific American Books distributed by WH Freeman & Co.).

Gene Targeting

The guide polynucleotide/Cas systems described herein can be used for gene targeting.

In general, DNA targeting can be performed by cleaving one or both strands at a specific polynucleotide sequence in a cell with a Cas protein associated with a suitable polynucleotide component. Once a single or double-strand break is induced in the DNA, the cell's DNA repair mechanism is activated to repair the break via nonhomologous end-joining (NHEJ) or Homology-Directed Repair (HDR) processes which can lead to modifications at the target site.

The length of the DNA sequence at the target site can vary, and includes, for example, target sites that are at least 12, 13, 14, 15, 16, 17, 18, 19, 20, 21, 22, 23, 24, 25, 26, 27, 28, 29, 30, or more than 30 nucleotides in length. It is further possible that the target site can be palindromic, that is, the sequence on one strand reads the same in the opposite direction on the complementary strand. The nick/cleavage site can be within the target sequence or the nick/cleavage site could be outside of the target sequence. In another variation, the cleavage could occur at nucleotide positions immediately opposite each other to produce a blunt end cut or, in other cases, the incisions could be staggered to produce single-stranded overhangs, also called "sticky ends", which can be either 5' overhangs, or 3' overhangs. Active variants of genomic target sites can also be used. Such active variants can comprise at least 65%, 70%, 75%, 80%, 85%, 90%, 91%, 92%, 93%, 94%, 95%, 96%, 97%, 98%, 99% or more sequence identity to the given target site, wherein the active variants retain biological activity and hence are capable of being recognized and cleaved by an Cas endonuclease.

Assays to measure the single or double-strand break of a target site by an endonuclease are known in the art and generally measure the overall activity and specificity of the agent on DNA substrates comprising recognition sites.

A targeting method herein can be performed in such a way that two or more DNA target sites are targeted in the method, for example. Such a method can optionally be characterized as a multiplex method. Two, three, four, five, six, seven, eight, nine, ten, or more target sites can be targeted at the same time in certain embodiments. A multiplex method is typically performed by a targeting method herein in which multiple different RNA components are provided, each designed to guide a guide polynucleotide/Cas endonuclease complex to a unique DNA target site.

Gene Editing

The process for editing a genomic sequence combining DSB and modification templates generally comprises: introducing into a host cell a DSB-inducing agent, or a nucleic acid encoding a DSB-inducing agent, that recognizes a target sequence in the chromosomal sequence and is able to induce a DSB in the genomic sequence, and at least one polynucleotide modification template comprising at least one nucleotide alteration when compared to the nucleotide sequence to be edited. The polynucleotide modification template can further comprise nucleotide sequences flanking the at least one nucleotide alteration, in which the flanking sequences are substantially homologous to the chromosomal region flanking the DSB. Genome editing using DSB-inducing agents, such as Cas-gRNA complexes, has been described, for example in US20150082478 published on 19 Mar. 2015, WO2015026886 published on 26 Feb. 2015, WO2016007347 published 14 Jan. 2016, and WO/2016/025131 published on 18 Feb. 2016.

Some uses for guide RNA/Cas endonuclease systems have been described (see for example: US20150082478 A1 published 19 Mar. 2015, WO2015026886 published 26 Feb. 2015, and US20150059010 published 26 Feb. 2015) and include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Proteins may be altered in various ways including amino acid substitutions, deletions, truncations, and insertions. Methods for such manipulations are generally known. For example, amino acid sequence variants of the protein(s) can be prepared by mutations in the DNA. Methods for mutagenesis and nucleotide sequence alterations include, for example, Kunkel, (1985) *Proc. Natl. Acad. Sci. USA* 82:488-92; Kunkel et al., (1987) *Meth Enzymol* 154:367-82; U.S. Pat. No. 4,873,192; Walker and Gaastra, eds. (1983) *Techniques in Molecular Biology* (MacMillan Publishing Company, New York) and the references cited therein. Guidance regarding amino acid substitutions not likely to affect biological activity of the protein is found, for example, in the model of Dayhoff et al., (1978) *Atlas of Protein Sequence and Structure* (Natl Biomed Res Found, Washington, D.C.). Conservative substitutions, such as exchanging one amino acid with another having similar properties, may be preferable. Conservative deletions, insertions, and amino acid substitutions are not expected to produce radical changes in the characteristics of the protein, and the effect of any substitution, deletion, insertion, or combination thereof can be evaluated by routine screening assays. Assays for double-strand-break-inducing activity are known and generally measure the overall activity and specificity of the agent on DNA substrates comprising target sites.

Described herein are methods for genome editing with a Cas endonuclease and complexes with a Cas endonuclease and a guide polynucleotide. Following characterization of the guide RNA and PAM sequence, components of the endonuclease and associated CRISPR RNA (crRNA) may be utilized to modify chromosomal DNA in other organisms including plants. To facilitate optimal expression and nuclear localization (for eukaryotic cells), the genes comprising the complex may be optimized as described in WO2016186953 published 24 Nov. 2016, and then delivered into cells as DNA expression cassettes by methods known in the art. The components necessary to comprise an active complex may also be delivered as RNA with or without modifications that protect the RNA from degradation or as mRNA capped or uncapped (Zhang, Y. et al., 2016, *Nat. Commun.* 7:12617) or Cas protein guide polynucleotide complexes (WO2017070032 published 27 Apr. 2017), or any combination thereof. Additionally, a part or part(s) of the complex and crRNA may be expressed from a DNA construct while other components are delivered as RNA with or without modifications that protect the RNA from degradation or as mRNA capped or uncapped (Zhang et al. 2016 *Nat. Commun.* 7:12617) or Cas protein guide polynucleotide complexes (WO2017070032 published 27 Apr. 2017) or any combination thereof. To produce crRNAs in-vivo, tRNA derived elements may also be used to recruit endogenous RNAses to cleave crRNA transcripts into mature forms capable of guiding the complex to its DNA target site, as described, for example, in WO2017105991 published 22 Jun. 2017. Nickase complexes may be utilized separately or concertedly to generate a single or multiple DNA nicks on one or both DNA strands. Furthermore, the cleavage activity of the Cas endonuclease may be deactivated by altering key catalytic residues in its cleavage domain (Sinkunas, T. et al., 2013, *EMBO J.* 32:385-394) resulting in a RNA guided helicase that may be used to enhance homology directed repair, induce transcriptional activation, or remodel local DNA structures. Moreover, the activity of the Cas cleavage and helicase domains may both be knocked-out and used in combination with other DNA cutting, DNA nicking, DNA binding, transcriptional activation, transcriptional repression, DNA remodeling, DNA deamination, DNA unwinding, DNA recombination enhancing, DNA integration, DNA inversion, and DNA repair agents.

The transcriptional direction of the tracrRNA for the CRISPR-Cas system (if present) and other components of the CRISPR-Cas system (such as variable targeting domain, crRNA repeat, loop, anti-repeat) can be deduced as described in WO2016186946 published 24 Nov. 2016, and WO2016186953 published 24 Nov. 2016.

As described herein, once the appropriate guide RNA requirement is established, the PAM preferences for each new system disclosed herein may be examined. If the cleavage complex results in degradation of the randomized PAM library, the complex can be converted into a nickase by disabling the ATPase dependent helicase activity either through mutagenesis of critical residues or by assembling the reaction in the absence of ATP as described previously (Sinkunas, T. et al., 2013, *EMBO J.* 32:385-394). Two regions of PAM randomization separated by two protospacer targets may be utilized to generate a double-stranded DNA break which may be captured and sequenced to examine the PAM sequences that support cleavage by the respective complex.

In one embodiment, the invention describes a method for modifying a target site in the genome of a cell, the method comprising introducing into a cell at least one PGEN described herein, and identifying at least one cell that has a modification at said target, wherein the modification at said target site is selected from the group consisting of (i) a replacement of at least one nucleotide, (ii) a deletion of at least one nucleotide, (iii) an insertion of at least one nucleotide, the chemical alteration of at least one nucleotide, and (v) any combination of (i)-(iv).

The nucleotide to be edited can be located within or outside a target site recognized and cleaved by a Cas endonuclease. In one embodiment, the at least one nucleotide modification is not a modification at a target site recognized and cleaved by a Cas endonuclease. In another embodiment, there are at least 1, 2, 3, 4, 5, 6, 7, 8, 9, 10, 11, 12, 13, 14, 15, 16, 17, 18, 19, 20, 21, 22, 23, 24, 25, 26, 27, 30, 40, 50, 100, 200, 300, 400, 500, 600, 700, 900 or 1000 nucleotides between the at least one nucleotide to be edited and the genomic target site.

A knock-out may be produced by an indel (insertion or deletion of nucleotide bases in a target DNA sequence through NHEJ), or by specific removal of sequence that reduces or completely destroys the function of sequence at or near the targeting site.

A guide polynucleotide/Cas endonuclease induced targeted mutation can occur in a nucleotide sequence that is located within or outside a genomic target site that is recognized and cleaved by the Cas endonuclease.

The method for editing a nucleotide sequence in the genome of a cell can be a method without the use of an exogenous selectable marker by restoring function to a non-functional gene product.

In one embodiment, the invention describes a method for modifying a target site in the genome of a cell, the method comprising introducing into a cell at least one PGEN described herein and at least one donor DNA, wherein said donor DNA comprises a polynucleotide of interest, and optionally, further comprising identifying at least one cell that said polynucleotide of interest integrated in or near said target site.

In one aspect, the methods disclosed herein may employ homologous recombination (HR) to provide integration of the polynucleotide of interest at the target site.

Various methods and compositions can be employed to produce a cell or organism having a polynucleotide of interest inserted in a target site via activity of a CRISPR-Cas system component described herein. In one method described herein, a polynucleotide of interest is introduced into the organism cell via a donor DNA construct. As used herein, "donor DNA" is a DNA construct that comprises a polynucleotide of interest to be inserted into the target site of a Cas endonuclease. The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods* Vol. 10:957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) Current Protocols, (Greene Publishing Associates, Inc. and John Wiley & Sons, Inc.); and, Tijssen (1993) *Laboratory Techniques in Biochemistry and Molecular Biology—Hybridization with Nucleic Acid Probes*, (Elsevier, New York).

Episomal DNA molecules can also be ligated into the double-strand break, for example, integration of T-DNAs into chromosomal double-strand breaks (Chilton and Que, (2003) *Plant Physiol* 133:956-65; Salomon and Puchta, (1998) *EMBO J*. 17:6086-95). Once the sequence around the double-strand breaks is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) *Plant Cell* 16:342-52). Ectopic and/or epigenic DNA sequences may also serve as a DNA repair template for homologous recombination (Puchta, (1999) *Genetics* 152: 1173-81).

In one embodiment, the disclosure comprises a method for editing a nucleotide sequence in the genome of a cell, the method comprising introducing into at least one PGEN described herein, and a polynucleotide modification template, wherein said polynucleotide modification template comprises at least one nucleotide modification of said nucleotide sequence, and optionally further comprising selecting at least one cell that comprises the edited nucleotide sequence.

The guide polynucleotide/Cas endonuclease system can be used in combination with at least one polynucleotide modification template to allow for editing (modification) of a genomic nucleotide sequence of interest. (See also US20150082478, published 19 Mar. 2015 and WO2015026886 published 26 Feb. 2015).

Polynucleotides of interest and/or traits can be stacked together in a complex trait locus as described in WO2012129373 published 27 Sep. 2012, and in WO2013112686, published 1 Aug. 2013. The guide polynucleotide/Cas9 endonuclease system described herein provides for an efficient system to generate double-strand breaks and allows for traits to be stacked in a complex trait locus.

A guide polynucleotide/Cas system as described herein, mediating gene targeting, can be used in methods for directing heterologous gene insertion and/or for producing complex trait loci comprising multiple heterologous genes in a fashion similar as disclosed in WO2012129373 published 27 Sep. 2012, where instead of using a double-strand break inducing agent to introduce a gene of interest, a guide polynucleotide/Cas system as disclosed herein is used. By inserting independent transgenes within 0.1, 0.2, 0.3, 0.4, 0.5, 1.0, 2, or even 5 centimorgans (cM) from each other, the transgenes can be bred as a single genetic locus (see, for example, US20130263324 published 3 Oct. 2013 or WO2012129373 published 14 Mar. 2013). After selecting a plant comprising a transgene, plants comprising (at least) one transgenes can be crossed to form an F1 that comprises both transgenes. In progeny from these F1 (F2 or BC1) 1/500 progeny would have the two different transgenes recombined onto the same chromosome. The complex locus can then be bred as single genetic locus with both transgene traits. This process can be repeated to stack as many traits as desired.

Further uses for guide RNA/Cas endonuclease systems have been described (See for example: US20150082478 published 19 Mar. 2015, WO2015026886 published 26 Feb. 2015, US20150059010 published 26 Feb. 2015, WO2016007347 published 14 Jan. 2016, and PCT application WO2016025131 published 18 Feb. 2016) and include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Resulting characteristics from the gene editing compositions and methods described herein may be evaluated. Chromosomal intervals that correlate with a phenotype or trait of interest can be identified. A variety of methods well known in the art are available for identifying chromosomal intervals. The boundaries of such chromosomal intervals are drawn to encompass markers that will be linked to the gene controlling the trait of interest. In other words, the chromosomal interval is drawn such that any marker that lies within that interval (including the terminal markers that define the boundaries of the interval) can be used as a marker for a particular trait. In one embodiment, the chromosomal interval comprises at least one QTL, and furthermore, may indeed comprise more than one QTL. Close proximity of multiple QTLs in the same interval may obfuscate the correlation of a particular marker with a particular QTL, as one marker may demonstrate linkage to more than one QTL. Conversely, e.g., if two markers in close proximity show co-segregation with the desired phenotypic trait, it is sometimes unclear if each of those markers identifies the same QTL or two different QTL. The term "quantitative trait locus" or "QTL" refers to a region of DNA that is associated with the differential expression of a quantitative phenotypic trait in at least one genetic background, e.g., in at least one breeding population. The region of the QTL encompasses or is closely linked to the gene or genes that affect the trait in question. An "allele of a QTL" can comprise multiple genes or other genetic factors within a contiguous genomic region or linkage group, such as a haplotype. An allele of a QTL can denote a haplotype within a specified window wherein said window is a contiguous genomic region that can be defined, and tracked, with a set of one or more polymorphic markers. A haplotype can be defined by the unique fingerprint of alleles at each marker within the specified window.

Introduction of CRISPR-Cas System Components into a Cell

The methods and compositions described herein do not depend on a particular method for introducing a sequence into an organism or cell, only that the polynucleotide or polypeptide gains access to the interior of at least one cell of the organism. Introducing includes reference to the incorporation of a nucleic acid into a eukaryotic or prokaryotic cell where the nucleic acid may be incorporated into the genome of the cell, and includes reference to the transient (direct) provision of a nucleic acid, protein or polynucleotide-protein complex (PGEN, RGEN) to the cell.

Methods for introducing polynucleotides or polypeptides or a polynucleotide-protein complex into cells or organisms are known in the art including, but not limited to, microinjection, electroporation, stable transformation methods, transient transformation methods, ballistic particle acceleration (particle bombardment), whiskers mediated transformation, *Agrobacterium*-mediated transformation, direct gene transfer, viral-mediated introduction, transfection, transduction, cell-penetrating peptides, mesoporous silica nanoparticle (MSN)-mediated direct protein delivery, topical applications, sexual crossing, sexual breeding, and any combination thereof.

For example, the guide polynucleotide (guide RNA, crNucleotide+tracrNucleotide, guide DNA and/or guide RNA-DNA molecule) can be introduced into a cell directly (transiently) as a single stranded or double stranded polynucleotide molecule. The guide RNA (or crRNA+tracrRNA) can also be introduced into a cell indirectly by introducing a recombinant DNA molecule comprising a heterologous nucleic acid fragment encoding the guide RNA (or crRNA+tracrRNA), operably linked to a specific promoter that is capable of transcribing the guide RNA (crRNA+tracrRNA molecules) in said cell. The specific promoter can be, but is not limited to, a RNA polymerase III promoter, which allow for transcription of RNA with precisely defined, unmodified, 5'- and 3'-ends (Ma et al., 2014, *Mol. Ther. Nucleic Acids* 3:e161; DiCarlo et al., 2013, *Nucleic Acids Res.* 41:4336-4343; WO2015026887, published 26 Feb. 2015). Any promoter capable of transcribing the guide RNA in a cell can be used and includes a heat shock/heat inducible promoter operably linked to a nucleotide sequence encoding the guide RNA.

Plant cells differ from animal cells (such as human cells), fungal cells (such as yeast cells) and protoplasts, including for example plant cells comprise a plant cell wall which may act as a barrier to the delivery of components.

Delivery of the Cas endonuclease, and/or the guide RNA, and/or a ribonucleoprotein complex, and/or a polynucleotide encoding any one or more of the preceding, into plant cells can be achieved through methods known in the art, for example but not limited to: *Rhizobiales*-mediated transformation (e.g., *Agrobacterium, Ochrobactrum*), particle mediated delivery (particle bombardment), polyethylene glycol (PEG)-mediated transfection (for example to protoplasts), electroporation, cell-penetrating peptides, or mesoporous silica nanoparticle (MSN)-mediated direct protein delivery.

The Cas endonuclease, such as the Cas endonuclease described herein, can be introduced into a cell by directly introducing the Cas polypeptide itself (referred to as direct delivery of Cas endonuclease), the mRNA encoding the Cas protein, and/or the guide polynucleotide/Cas endonuclease complex itself, using any method known in the art. The Cas endonuclease can also be introduced into a cell indirectly by introducing a recombinant DNA molecule that encodes the Cas endonuclease. The endonuclease can be introduced into a cell transiently or can be incorporated into the genome of the host cell using any method known in the art. Uptake of the endonuclease and/or the guided polynucleotide into the cell can be facilitated with a Cell Penetrating Peptide (CPP) as described in WO2016073433 published 12 May 2016. Any promoter capable of expressing the Cas endonuclease in a cell can be used and includes a heat shock/heat inducible promoter operably linked to a nucleotide sequence encoding the Cas endonuclease.

Direct delivery of a polynucleotide modification template into plant cells can be achieved through particle mediated delivery, and any other direct method of delivery, such as but not limiting to, polyethylene glycol (PEG)-mediated transfection to protoplasts, whiskers mediated transformation, electroporation, particle bombardment, cell-penetrating peptides, or mesoporous silica nanoparticle (MSN)-mediated direct protein delivery can be successfully used for delivering a polynucleotide modification template in eukaryotic cells, such as plant cells.

The donor DNA can be introduced by any means known in the art. The donor DNA may be provided by any transformation method known in the art including, for example, *Agrobacterium*-mediated transformation or biolistic particle bombardment. The donor DNA may be present transiently in the cell or it could be introduced via a viral replicon. In the presence of the Cas endonuclease and the target site, the donor DNA is inserted into the transformed plant's genome.

Direct delivery of any one of the guided Cas system components can be accompanied by direct delivery (co-delivery) of other mRNAs that can promote the enrichment and/or visualization of cells receiving the guide polynucleotide/Cas endonuclease complex components. For example, direct co-delivery of the guide polynucleotide/Cas endonuclease components (and/or guide polynucleotide/Cas endonuclease complex itself) together with mRNA encoding phenotypic markers (such as but not limiting to transcriptional activators such as CRC (Bruce et al. 2000 *The Plant Cell* 12:65-79) can enable the selection and enrichment of cells without the use of an exogenous selectable marker by restoring function to a non-functional gene product as described in WO2017070032 published 27 Apr. 2017.

Introducing a guide RNA/Cas endonuclease complex described herein, (representing the cleavage ready complex described herein) into a cell includes introducing the individual components of said complex either separately or combined into the cell, and either directly (direct delivery as RNA for the guide and protein for the Cas endonuclease and protein subunits, or functional fragments thereof) or via recombination constructs expressing the components (guide RNA, Cas endonuclease, protein subunits, or functional fragments thereof). Introducing a guide RNA/Cas endonuclease complex (RGEN) into a cell includes introducing the guide RNA/Cas endonuclease complex as a ribonucleotide-protein into the cell. The ribonucleotide-protein can be assembled prior to being introduced into the cell as described herein. The components comprising the guide RNA/Cas endonuclease ribonucleotide protein (at least one Cas endonuclease, at least one guide RNA, at least one protein subunit) can be assembled in vitro or assembled by any means known in the art prior to being introduced into a cell (targeted for genome modification as described herein).

Direct delivery of the RGEN ribonucleoprotein, allows for genome editing at a target site in the genome of a cell which can be followed by rapid degradation of the complex, and only a transient presence of the complex in the cell. This transient presence of the RGEN complex may lead to reduced off-target effects. In contrast, delivery of RGEN components (guide RNA, Cas9 endonuclease) via plasmid DNA sequences can result in constant expression of RGENs from these plasmids which can intensify off target effects (Cradick, T. J. et al. (2013) *Nucleic Acids Res* 41:9584-9592; Fu, Y et al. (2014) *Nat. Biotechnol.* 31:822-826).

Direct delivery can be achieved by combining any one component of the guide RNA/Cas endonuclease complex (RGEN), representing the cleavage ready complex described herein, (such as at least one guide RNA, at least one Cas protein, and optionally one additional protein), with a delivery matrix comprising a microparticle (such as but not limited to of a gold particle, tungsten particle, and silicon carbide whisker particle) (see also WO2017070032 published 27 Apr. 2017). The delivery matrix may comprise any one of the components, such as the Cas endonuclease, that is attached to a solid matrix (e.g., a particle for bombardment).

In one aspect the guide polynucleotide/Cas endonuclease complex, is a complex wherein the guide RNA and Cas endonuclease protein forming the guide RNA/Cas endonuclease complex are introduced into the cell as RNA and protein, respectively.

In one aspect the guide polynucleotide/Cas endonuclease complex, is a complex wherein the guide RNA and Cas endonuclease protein and the at least one protein subunit of a complex forming the guide RNA/Cas endonuclease complex are introduced into the cell as RNA and proteins, respectively.

In one aspect the guide polynucleotide/Cas endonuclease complex, is a complex wherein the guide RNA and Cas endonuclease protein and the at least one protein subunit of a complex forming the guide RNA/Cas endonuclease complex (cleavage ready complex) are preassembled in vitro and introduced into the cell as a ribonucleotide-protein complex.

Protocols for introducing polynucleotides, polypeptides or polynucleotide-protein complexes (PGEN, RGEN) into eukaryotic cells, such as plants or plant cells are known and include microinjection (Crossway et al., (1986) *Biotechniques* 4:320-34 and U.S. Pat. No. 6,300,543), meristem transformation (U.S. Pat. No. 5,736,369), electroporation (Riggs et al., (1986) *Proc. Natl. Acad. Sci. USA* 83:5602-6, *Agrobacterium*-mediated transformation (U.S. Pat. Nos. 5,563,055 and 5,981,840), whiskers mediated transformation (Ainley et al. 2013, *Plant Biotechnology Journal* 11:1126-1134; Shaheen A. and M. Arshad 2011 Properties and Applications of Silicon Carbide (2011), 345-358 Editor(s): Gerhardt, Rosario. Publisher: InTech, Rijeka, Croatia. CODEN:69PQBP; ISBN:978-953-307-201-2), direct gene transfer (Paszkowski et al., (1984) *EMBO J* 3:2717-22), and ballistic particle acceleration (U.S. Pat. Nos. 4,945,050; 5,879,918; 5,886,244; 5,932,782; Tomes et al., (1995) "Direct DNA Transfer into Intact Plant Cells via Microprojectile Bombardment" in *Plant Cell, Tissue, and Organ Culture: Fundamental Methods*, ed. Gamborg & Phillips (Springer-Verlag, Berlin); McCabe et al., (1988) *Biotechnology* 6:923-6; Weissinger et al., (1988) *Ann Rev Genet* 22:421-77; Sanford et al., (1987) *Particulate Science and Technology* 5:27-37 (onion); Christou et al., (1988) *Plant Physiol* 87:671-4 (soybean); Finer and McMullen, (1991) *In vitro Cell Dev Biol* 27P:175-82 (soybean); Singh et al., (1998) *Theor Appl Genet* 96:319-24 (soybean); Datta et al., (1990) *Biotechnology* 8:736-40 (rice); Klein et al., (1988) *Proc. Natl. Acad. Sci. USA* 85:4305-9 (maize); Klein et al., (1988) *Biotechnology* 6:559-63 (maize); U.S. Pat. Nos. 5,240,855; 5,322,783 and 5,324,646; Klein et al., (1988) *Plant Physiol* 91:440-4 (maize); Fromm et al., (1990) *Biotechnology* 8:833-9 (maize); Hooykaas-Van Slogteren et al., (1984) *Nature* 311:763-4; U.S. Pat. No. 5,736,369 (cereals); Bytebier et al., (1987) *Proc. Natl. Acad. Sci. USA* 84:5345-9 (Liliaceae); De Wet et al., (1985) in *The Experimental Manipulation of Ovule Tissues*, ed. Chapman et al., (Longman, N.Y.), pp. 197-209 (pollen); Kaeppler et al., (1990) *Plant Cell Rep* 9:415-8) and Kaeppler et al., (1992) *Theor Appl Genet* 84:560-6 (whisker-mediated transformation); D'Halluin et al., (1992) *Plant Cell* 4:1495-505 (electroporation); Li et al., (1993) *Plant Cell Rep* 12:250-5; Christou and Ford (1995) *Annals Botany* 75:407-13 (rice) and Osjoda et al., (1996) *Nat Biotechnol* 14:745-50 (maize via *Agrobacterium tumefaciens*).

Alternatively, polynucleotides may be introduced into plant or plant cells by contacting cells or organisms with a virus or viral nucleic acids. Generally, such methods involve incorporating a polynucleotide within a viral DNA or RNA molecule. In some examples a polypeptide of interest may be initially synthesized as part of a viral polyprotein, which is later processed by proteolysis in vivo or in vitro to produce the desired recombinant protein. Methods for introducing polynucleotides into plants and expressing a protein encoded therein, involving viral DNA or RNA molecules, are known, see, for example, U.S. Pat. Nos. 5,889,191, 5,889,190, 5,866,785, 5,589,367 and 5,316,931.

The polynucleotide or recombinant DNA construct can be provided to or introduced into a prokaryotic and eukaryotic cell or organism using a variety of transient transformation methods. Such transient transformation methods include, but are not limited to, the introduction of the polynucleotide construct directly into the plant.

Nucleic acids and proteins can be provided to a cell by any method including methods using molecules to facilitate the uptake of anyone or all components of a guided Cas system (protein and/or nucleic acids), such as cell-penetrating peptides and nanocarriers. See also US20110035836 published 10 Feb. 2011, and EP2821486A1 published 7 Jan. 2015.

Other methods of introducing polynucleotides into a prokaryotic and eukaryotic cell or organism or plant part can be used, including plastid transformation methods, and the methods for introducing polynucleotides into tissues from seedlings or mature seeds.

Stable transformation is intended to mean that the nucleotide construct introduced into an organism integrates into a genome of the organism and is capable of being inherited by the progeny thereof. Transient transformation is intended to mean that a polynucleotide is introduced into the organism and does not integrate into a genome of the organism or a polypeptide is introduced into an organism. Transient transformation indicates that the introduced composition is only temporarily expressed or present in the organism.

A variety of methods are available to identify those cells having an altered genome at or near a target site without using a screenable marker phenotype. Such methods can be viewed as directly analyzing a target sequence to detect any change in the target sequence, including but not limited to PCR methods, sequencing methods, nuclease digestion, Southern blots, and any combination thereof.

Cells and Plants

The presently disclosed polynucleotides and polypeptides can be introduced into a cell. Cells include, but are not limited to, human, non-human, animal, mammalian, bacterial, fungal, insect, yeast, non-conventional yeast, and plant cells as well as plants and seeds produced by the methods described herein. Any plant can be used with the compositions and methods described herein, including monocot and dicot plants, and plant elements.

Examples of monocot plants that can be used include, but are not limited to, corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum* species, for example *Triticum aestivum, Triticum monococcum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, and other grasses.

Examples of dicot plants that can be used include, but are not limited to, soybean (*Glycine max*), *Brassica* species (for example but not limited to: oilseed rape or Canola) (*Brassica napus, B. campestris, Brassica rapa, Brassica. juncea*), alfalfa (*Medicago sativa*), tobacco (*Nicotiana tabacum*), *Arabidopsis* (*Arabidopsis thaliana*), sunflower (*Helianthus annuus*), cotton (*Gossypium arboreum, Gossypium bar-*

*badense*), and peanut (*Arachis hypogaea*), tomato (*Solanum lycopersicum*), potato (*Solanum tuberosum*.

Additional plants that can be used include safflower (*Carthamus tinctorius*), sweet potato (*Ipomoea batatus*), cassava (*Manihot esculenta*), coffee (*Coffea* spp.), coconut (*Cocos nucifera*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), vegetables, ornamentals, and conifers.

Vegetables that can be used include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be used include pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow cedar (*Chamaecyparis nootkatensis*).

In certain embodiments of the disclosure, a fertile plant is a plant that produces viable male and female gametes and is self-fertile. Such a self-fertile plant can produce a progeny plant without the contribution from any other plant of a gamete and the genetic material comprised therein. Other embodiments of the disclosure can involve the use of a plant that is not self-fertile because the plant does not produce male gametes, or female gametes, or both, that are viable or otherwise capable of fertilization.

The present disclosure finds use in the breeding of plants comprising one or more introduced traits, or edited genomes.

A non-limiting example of how two traits can be stacked into the genome at a genetic distance of, for example, 5 cM from each other is described as follows: A first plant comprising a first transgenic target site integrated into a first DSB target site within the genomic window and not having the first genomic locus of interest is crossed to a second transgenic plant, comprising a genomic locus of interest at a different genomic insertion site within the genomic window and the second plant does not comprise the first transgenic target site. About 5% of the plant progeny from this cross will have both the first transgenic target site integrated into a first DSB target site and the first genomic locus of interest integrated at different genomic insertion sites within the genomic window. Progeny plants having both sites in the defined genomic window can be further crossed with a third transgenic plant comprising a second transgenic target site integrated into a second DSB target site and/or a second genomic locus of interest within the defined genomic window and lacking the first transgenic target site and the first genomic locus of interest. Progeny are then selected having the first transgenic target site, the first genomic locus of interest and the second genomic locus of interest integrated at different genomic insertion sites within the genomic window. Such methods can be used to produce a transgenic plant comprising a complex trait locus having at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more transgenic target sites integrated into DSB target sites and/or genomic loci of interest integrated at different sites within the genomic window. In such a manner, various complex trait loci can be generated.

Cells and Animals

The presently disclosed polynucleotides and polypeptides can be introduced into an animal cell. Animal cells can include, but are not limited to: an organism of a phylum including chordates, arthropods, mollusks, annelids, cnidarians, or echinoderms; or an organism of a class including mammals, insects, birds, amphibians, reptiles, or fishes. In some aspects, the animal is human, mouse, *C. elegans*, rat, fruit fly (*Drosophila* spp.), zebrafish, chicken, dog, cat, guinea pig, hamster, chicken, Japanese ricefish, sea lamprey, pufferfish, tree frog (e.g., *Xenopus* spp.), monkey, or chimpanzee. Particular cell types that are contemplated include haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells. In some aspects, a plurality of cells from an organism may be used.

The novel Cas9 orthologs disclosed may be used to edit the genome of an animal cell in various ways. In one aspect, it may be desirable to delete one or more nucleotides. In another aspect, it may be desirable to insert one or more nucleotides. In one aspect, it may be desirable to replace one or more nucleotides. In another aspect, it may be desirable to modify one or more nucleotides via a covalent or non-covalent interaction with another atom or molecule.

Genome modification via a Cas9 ortholog may be used to effect a genotypic and/or phenotypic change on the target organism. Such a change is preferably related to an improved phenotype of interest or a physiologically-important characteristic, the correction of an endogenous defect, or the expression of some type of expression marker. In some aspects, the phenotype of interest or physiologically-important characteristic is related to the overall health, fitness, or fertility of the animal, the ecological fitness of the animal, or the relationship or interaction of the animal with other organisms in its environment. In some aspects, the phenotype of interest or physiologically-important characteristic is selected from the group consisting of: improved general health, disease reversal, disease modification, disease stabilization, disease prevention, treatment of parasitic infections, treatment of viral infections, treatment of retroviral infections, treatment of bacterial infections, treatment of neurological disorders (for example but not limited to: multiple sclerosis), correction of endogenous genetic defects (for example but not limited to: metabolic disorders, Achondroplasia, Alpha-1 Antitrypsin Deficiency, Antiphospholipid Syndrome, Autism, Autosomal Dominant Polycystic Kidney Disease, Barth syndrome, Breast cancer, Charcot-Marie-Tooth, Colon cancer, Cri du chat, Crohn's Disease, Cystic fibrosis, Dercum Disease, Down Syndrome, Duane Syndrome, Duchenne Muscular Dystrophy, Factor V Leiden Thrombophilia, Familial Hypercholesterolemia, Familial Mediterranean Fever, Fragile X Syndrome, Gaucher Disease, Hemochromatosis, Hemophilia, Holoprosencephaly, Huntington's disease, Klinefelter syndrome, Marfan syndrome, Myotonic Dystrophy, Neurofibromatosis, Noonan Syndrome, Osteogenesis Imperfecta, Parkinson's disease, Phenylketonuria, Poland Anomaly, *Porphyria*, Progeria, Prostate Cancer, Retinitis Pigmentosa, Severe Combined Immunodeficiency (SCID), Sickle cell disease, Skin Cancer, Spinal Muscular Atrophy, Tay-Sachs, Thalassemia, Trimethylaminuria, Turner Syndrome, Velocardiofacial Syndrome, WAGR Syndrome, and Wilson Disease), treatment of innate immune disorders (for example but not limited to: immunoglobulin subclass deficiencies), treatment of acquired immune disorders (for example but not limited to: AIDS and other HIV-related disorders), treatment of cancer, as well as treatment of diseases, including rare or "orphan" conditions, that have eluded effective treatment options with other methods.

Cells that have been genetically modified using the compositions or methods disclosed herein may be transplanted to a subject for purposes such as gene therapy, e.g. to treat a disease, or as an antiviral, antipathogenic, or anticancer therapeutic, for the production of genetically modified organisms in agriculture, or for biological research.

In Vitro Polynucleotide Detection, Binding, and Modification

The compositions disclosed herein may further be used as compositions for use in in vitro methods, in some aspects with isolated polynucleotide sequence(s). Said isolated polynucleotide sequence(s) may comprise one or more target sequence(s) for modification. In some aspects, said isolated polynucleotide sequence(s) may be genomic DNA, a PCR product, or a synthesized oligonucleotide.

Compositions

Modification of a target sequence may be in the form of a nucleotide insertion, a nucleotide deletion, a nucleotide substitution, the addition of an atom molecule to an existing nucleotide, a nucleotide modification, or the binding of a heterologous polynucleotide or polypeptide to said target sequence. The insertion of one or more nucleotides may be accomplished by the inclusion of a donor polynucleotide in the reaction mixture: said donor polynucleotide is inserted into a double-strand break created by said Cas-alpha ortholog polypeptide. The insertion may be via non-homologous end joining or via homologous recombination.

In one aspect, the sequence of the target polynucleotide is known prior to modification, and compared to the sequence(s) of polynucleotide(s) that result from treatment with the Cas-alpha ortholog. In one aspect, the sequence of the target polynucleotide is not known prior to modification, and the treatment with the Cas-alpha ortholog is used as part of a method to determine the sequence of said target polynucleotide.

Polynucleotide modification with a Cas-alpha ortholog may be accomplished by usage of a full-length polypeptide identified from a Cas locus, or from a fragment, modification, or variant of a polypeptide identified from a Cas locus. In some aspects, said Cas-alpha ortholog is obtained or derived from an organism listed in Table 1. In some aspects, said Cas-alpha ortholog is a polypeptide sharing at least 80% identity with any of SEQ ID NOs:86-170 or 511-1135. In some aspects, said Cas-alpha ortholog is a functional variant of any of SEQ ID NOs:86-170 or 511-1135. In some aspects, said Cas-alpha ortholog is a functional fragment of any of SEQ ID NOs:86-170 or 511-1135. In some aspects, said Cas-alpha ortholog is a Cas-alpha polypeptide encoded by a polynucleotide selected from the group consisting of: SEQ ID NO:86-170 or 511-1135. In some aspects, said Cas-alpha ortholog is a Cas-alpha polypeptide that recognizes a PAM sequence listed in any of Tables 4-83. In some aspects, said Cas-alpha ortholog is a Cas-alpha polypeptide identified from an organism listed in the sequence listing.

In some aspects, the Cas-alpha ortholog is provided as a Cas-alpha polynucleotide. In some aspects, said Cas-alpha polynucleotide is selected from the group consisting of: SEQ ID NO:1-85, or a sequence sharing at least 80%, 85%, 90%, 95%, 97%, 99%, or 100% with any one of SEQ ID NO:1-85.

In some aspects, the Cas-alpha ortholog may be selected from the group consisting of: an unmodified wild type Cas-alpha ortholog, a functional Cas-alpha ortholog variant, a functional Cas-alpha ortholog fragment, a fusion protein comprising an active or deactivated Cas-alpha ortholog, a Cas-alpha ortholog further comprising one or more nuclear localization sequences (NLS) on the C-terminus or on the N-terminus or on both the N- and C-termini, a biotinylated Cas-alpha ortholog, a Cas-alpha ortholog nickase, a Cas-alpha ortholog endonuclease, a Cas-alpha ortholog further comprising a Histidine tag, and a mixture of any two or more of the preceding.

In some aspects, the Cas-alpha ortholog is a fusion protein further comprising a nuclease domain, a transcriptional activator domain, a transcriptional repressor domain, an epigenetic modification domain, a cleavage domain, a nuclear localization signal, a cell-penetrating domain, a translocation domain, a marker, or a transgene that is heterologous to the target polynucleotide sequence or to the cell from which said target polynucleotide sequence is obtained or derived.

In some aspects, a plurality of Cas-alpha orthologs may be desired. In some aspects, said plurality may comprise Cas-alpha orthologs derived from different source organisms or from different loci within the same organism. In some aspects, said plurality may comprise Cas-alpha orthologs with different binding specificities to the target polynucleotide. In some aspects, said plurality may comprise Cas-alpha orthologs with different cleavage efficiencies. In some aspects, said plurality may comprise Cas-alpha orthologs with different PAM specificities. In some aspects, said plurality may comprise orthologs of different molecular compositions, i.e., a polynucleotide Cas-alpha ortholog and a polypeptide Cas-alpha ortholog.

The guide polynucleotide may be provided as a single guide RNA (sgRNA), a chimeric molecule comprising a tracrRNA, a chimeric molecule comprising a crRNA, a chimeric RNA-DNA molecule, a DNA molecule, or a polynucleotide comprising one or more chemically modified nucleotides.

The storage conditions of the Cas-alpha ortholog and/or the guide polynucleotide include parameters for temperature, state of matter, and time. In some aspects, the Cas-alpha ortholog and/or the guide polynucleotide is stored at about −80 degrees Celsius, at about −20 degrees Celsius, at about 4 degrees Celsius, at about 20-25 degrees Celsius, or at about 37 degrees Celsius. In some aspects, the Cas-alpha ortholog and/or the guide polynucleotide is stored as a liquid, a frozen liquid, or as a lyophilized powder. In some aspects, the Cas-alpha ortholog and/or the guide polynucleotide is stable for at least one day, at least one week, at least one month, at least one year, or even greater than one year.

Any or all of the possible polynucleotide components of the reaction (e.g., guide polynucleotide, donor polynucleotide, optionally a Cas-alpha polynucleotide) may be provided as part of a vector, a construct, a linearized or circularized plasmid, or as part of a chimeric molecule. Each component may be provided to the reaction mixture separately or together. In some aspects, one or more of the polynucleotide components are operably linked to a heterologous noncoding regulatory element that regulates its expression.

The method for modification of a target polynucleotide comprises combining the minimal elements into a reaction mixture comprising: a Cas-alpha ortholog (or variant, fragment, or other related molecule as described above), a guide polynucleotide comprising a sequence that is substantially complementary to, or selectively hybridizes to, the target polynucleotide sequence of the target polynucleotide, and a target polynucleotide for modification. In some aspects, the Cas-alpha ortholog is provided as a polypeptide. In some aspects, the Cas-alpha ortholog is provided as a Cas-alpha ortholog polynucleotide. In some aspects, the guide polynucleotide is provided as an RNA molecule, a DNA molecule, an RNA:DNA hybrid, or a polynucleotide molecule comprising a chemically-modified nucleotide.

The storage buffer of any one of the components, or the reaction mixture, may be optimized for stability, efficacy, or other parameters. Additional components of the storage buffer or the reaction mixture may include a buffer composition, Tris, EDTA, dithiothreitol (DTT), phosphate-buffered saline (PBS), sodium chloride, magnesium chloride, HEPES, glycerol, BSA, a salt, an emulsifier, a detergent, a chelating agent, a redox reagent, an antibody, nuclease-free water, a proteinase, and/or a viscosity agent. In some aspects, the storage buffer or reaction mixture further comprises a buffer solution with at least one of the following components: HEPES, MgCl2, NaCl, EDTA, a proteinase, Proteinase K, glycerol, nuclease-free water.

Incubation conditions will vary according to desired outcome. The temperature is preferably at least 10 degrees Celsius, between 10 and 15, at least 15, between 15 and 17, at least 17, between 17 and 20, at least 20, between 20 and 22, at least 22, between 22 and 25, at least 25, between 25 and 27, at least 27, between 27 and 30, at least 30, between 30 and 32, at least 32, between 32 and 35, at least 35, at least 36, at least 37, at least 38, at least 39, at least 40, or even greater than 40 degrees Celsius. The time of incubation is at least 1 minute, at least 2 minutes, at least 3 minutes, at least 4 minutes, at least 5 minutes, at least 6 minutes, at least 7 minutes, at least 8 minutes, at least 9 minutes, at least 10 minutes, or even greater than 10 minutes.

The sequence(s) of the polynucleotide(s) in the reaction mixture prior to, during, or after incubation may be determined by any method known in the art. In one aspect, modification of a target polynucleotide may be ascertained by comparing the sequence(s) of the polynucleotide(s) purified from the reaction mixture to the sequence of the target polynucleotide prior to combining with the Cas-alpha ortholog.

Any one or more of the compositions disclosed herein, useful for in vitro or in vivo polynucleotide detection, binding, and/or modification, may be comprised within a kit. A kit comprises a Cas-alpha ortholog or a polynucleotide Cas-alpha ortholog encoding such, optionally further comprising buffer components to enable efficient storage, and one or more additional compositions that enable the introduction of said Cas-alpha ortholog or Cas-alpha ortholog to a heterologous polynucleotide, wherein said Cas-alpha ortholog or Cas-alpha ortholog is capable of effecting a modification, addition, deletion, or substitution of at least one nucleotide of said heterologous polynucleotide. In an additional aspect, a Cas-alpha ortholog disclosed herein may be used for the enrichment of one or more polynucleotide target sequences from a mixed pool. In an additional aspect, a Cas-alpha ortholog disclosed herein may be immobilized on a matrix for use in in vitro target polynucleotide detection, binding, and/or modification.

A Cas-alpha endonuclease may be attached, associated with, or affixed to a solid matrix for the purposes of storage, purification, and/or characterization. Examples of a solid matrix include, but are not limited to: a filter, a chromatography resin, an assay plate, a test tube, a cryogenic vial, etc. A Cas-alpha endonuclease may be substantially purified and stored in an appropriate buffer solution, or lyophilized.

Methods of Detection

Methods of detecting the Cas-alpha: guide polynucleotide complex bound to the target polynucleotide may include any known in the art, including but not limited to microscopy, chromatographic separation, electrophoresis, immunoprecipitation, filtration, nanopore separation, microarrays, as well as those described below.

A DNA Electrophoretic Mobility Shift Assay (EMSA): studies proteins binding to known DNA oligonucleotide probes and assesses the specificity of the interaction. The technique is based on the principle that protein-DNA complexes migrate more slowly than free DNA molecules when subjected to polyacrylamide or agarose gel electrophoresis. Because the rate of DNA migration is retarded upon protein binding, the assay is also called a gel retardation assay. Adding a protein-specific antibody to the binding components creates an even larger complex (antibody-protein-DNA) which migrates even slower during electrophoresis, this is known as a supershift and can be used to confirm protein identities.

DNA Pull-down Assays use a DNA probe labelled with a high affinity tag, such as biotin, which allows the probe to be recovered or immobilized. A DNA probe can be complexed with a protein from a cell lysate in a reaction similar to that used in the EMSA and then used to purify the complex using agarose or magnetic beads. The proteins are then eluted from the DNA and detected by Western blot or identified by mass spectrometry. Alternatively, the protein may be labelled with an affinity tag or the DNA-protein complex may be isolated using an antibody against the protein of interest (similar to a supershift assay). In this case, the unknown DNA sequence bound by the protein is detected by Southern blotting or through PCR analysis.

Reporter assays provide a real-time in vivo read-out of translational activity for a promoter of interest. Reporter genes are fusions of a target promoter DNA sequence and a reporter gene DNA sequence which is customized by the researcher and the DNA sequence codes for a protein with detectable properties like firefly/*Renilla* luciferase or alkaline phosphatase. These genes produce enzymes only when the promoter of interest is activated. The enzyme, in turn, catalyses a substrate to produce either light or a colour change that can be detected by spectroscopic instrumentation. The signal from the reporter gene is used as an indirect determinant for the translation of endogenous proteins driven from the same promoter.

Microplate Capture and Detection Assays use immobilized DNA probes to capture specific protein-DNA interactions and confirm protein identities and relative amounts with target specific antibodies. Typically, a DNA probe is immobilized on the surface of 96- or 384-well microplates coated with streptavidin. A cellular extract is prepared and added to allow the binding protein to bind to the oligonucleotide. The extract is then removed and each well is washed several times to remove non-specifically bound proteins. Finally, the protein is detected using a specific antibody labelled for detection. This method can be extremely sensitive, detecting less than 0.2 pg of the target protein per well. This method may also be utilized for oligonucleotides labelled with other tags, such as primary amines that can be immobilized on microplates coated with an amine-reactive surface chemistry.

DNA Footprinting is one of the most widely used methods for obtaining detailed information on the individual nucleotides in protein—DNA complexes, even inside living cells. In such an experiment, chemicals or enzymes are used to modify or digest the DNA molecules.• When sequence specific proteins bind to DNA they can protect the binding sites from modification or digestion. This can subsequently be visualized by denaturing gel electrophoresis, where unprotected DNA is cleaved more or less at random. Therefore it appears as a 'ladder' of bands and the sites protected by proteins have no corresponding bands and look like foot prints in the pattern of bands. The foot prints there by identify specific nucleosides at the protein—DNA binding sites.

Microscopic techniques include optical, fluorescence, electron, and atomic force microscopy (AFM).

Chromatin immunoprecipitation analysis (ChIP) causes proteins to bind covalently to their DNA targets, after which they are unlinked and characterized separately.

Systematic Evolution of Ligands by EXponential enrichment (SELEX) exposes target proteins to a random library of oligonucleotides. Those genes that bind are separated and amplified by PCR.

Methods and compositions provided herein include, but are not limited to, the following aspects.

Aspect 1: A synthetic composition comprising: (a) a guide polynucleotide; (b) a Cas endonuclease comprising a C-terminal tri-split RuvC domain further comprising a bridge helix and at least one Zinc-finger domain, an alpha helix bundle, and a plurality of beta sheets forming a wedge-like domain, wherein the Cas endonuclease is fewer than 650 amino acids in length; and (c) a target sequence comprising a nucleotide sequence that shares complementarity with the guide polynucleotide; wherein the guide polynucleotide and the Cas endonuclease form a complex that cleaves a double stranded DNA polynucleotide comprising the target sequence.

Aspect 2: A synthetic composition comprising: (a) a guide polynucleotide; (b) a Cas endonuclease derived from an organism of a taxonomy selected from the group consisting of: *Archaea, Micrarchaeota, Acidibacillus sulfuroxidans, Candidatus Aureabacteria bacterium, Candidatus Micrarchaeota archaeon, Clostridium novyi, Parageobacillus thermoglucosidasius, Ruminococcus* sp., and *Syntrophomonas palmitatica*; wherein the Cas endonuclease forms a complex with the guide polynucleotide; and (c) a double-stranded DNA polynucleotide comprising a target sequence that binds to the guide polynucleotide; wherein the guide polynucleotide and the Cas endonuclease form a complex that cleaves the double stranded DNA polynucleotide comprising the target sequence.

Aspect 3: The synthetic composition of Aspect 1 or Aspect 2, wherein the Cas endonuclease further comprises a Zinc-finger domain near the N-terminus.

Aspect 4: The synthetic composition of Aspect 1 or Aspect 2, wherein the double-stranded DNA polynucleotide further comprises a PAM.

Aspect 5: The synthetic composition of Aspect 4, wherein the PAM comprises a plurality of Thymine nucleotides.

Aspect 6: The synthetic composition of Aspect 1 or Aspect 2, further comprising a heterologous polynucleotide.

Aspect 7: The synthetic composition of Aspect 1 or Aspect 2, wherein the guide polynucleotide comprises a 20 nucleotide region of complementarity with the target sequence.

Aspect 8: The synthetic composition of Aspect 1 or Aspect 2, wherein the guide polynucleotide is a duplex molecule comprising a tracrRNA and a crRNA.

Aspect 9: The synthetic composition of Aspect 1 or Aspect 2, wherein the guide polynucleotide is a single guide polynucleotide comprising a Cas Endonuclease Recognition domain and a Variable Targeting domain.

Aspect 10: The synthetic composition of Aspect 6, wherein the heterologous polynucleotide is an expression element.

Aspect 11: The synthetic composition of Aspect 6, wherein the heterologous polynucleotide is a transgene.

Aspect 12: The synthetic composition of Aspect 6, wherein the heterologous polynucleotide is a donor DNA molecule.

Aspect 13: The synthetic composition of Aspect 6, wherein the heterologous polynucleotide is a polynucleotide modification template.

Aspect 14: The synthetic composition of Aspect 1 or Aspect 2, wherein the CRISPR-Cas endonuclease further comprises a nuclear localization signal.

Aspect 15: The synthetic composition of Aspect 1 or Aspect 2, wherein the CRISPR-Cas endonuclease is Cas-alpha, or a functional fragment thereof.

Aspect 16: The synthetic composition of Aspect 1 or Aspect 2, wherein the CRISPR-Cas endonuclease is a catalytically-inactive Cas-alpha.

Aspect 17: The synthetic composition of Aspect 1 or Aspect 2, wherein the CRISPR-Cas endonuclease is a fusion protein comprising a functional fragment of Cas-alpha.

Aspect 18: The synthetic composition of Aspect 17, wherein the fusion protein further comprises another nuclease domain.

Aspect 19: The synthetic composition of Aspect 1 or Aspect 2, further comprising at least one additional polypeptide.

Aspect 20: The synthetic composition of Aspect 19, wherein the additional polypeptide is selected from the group consisting of: Cas1, Cas2, and Cas4.

Aspect 21: The synthetic composition of Aspect 1 or Aspect 2, further comprising a cell.

Aspect 22: The synthetic composition of Aspect 21, wherein the cell is a eukaryotic cell.

Aspect 23: The synthetic composition of Aspect 21, wherein the cell is a plant cell.

Aspect 24: The synthetic composition of Aspect 23, wherein the plant cell is a monocot cell or a dicot cell.

Aspect 25: The synthetic composition of Aspect 23, wherein the plant cell is from an organism selected from the group consisting of: maize, soybean, cotton, wheat, canola, oilseed rape, sorghum, rice, rye, barley, millet, oats, sugarcane, turfgrass, switchgrass, alfalfa, sunflower, tobacco, peanut, potato, *Arabidopsis*, safflower, and tomato.

Aspect 26: The synthetic composition of Aspect 21, further comprising a guide polynucleotide comprising a variable targeting domain that is substantially complementary to a target sequence in the genome of the cell Aspect 27: A polynucleotide encoding the synthetic composition of Aspect 1 or Aspect 2.

Aspect 28: The polynucleotide of Aspect 27, further comprising at least one additional polynucleotide.

Aspect 29: The polynucleotide of Aspect 28, wherein the at least one additional polynucleotide is an expression element.

Aspect 30: The polynucleotide of Aspect 28, wherein the at least one additional polynucleotide is a gene.

Aspect 31: The synthetic composition of Aspect 30, wherein the gene is selected from the group consisting of: cas1, cas2, and cas4.

Aspect 32: The polynucleotide of Aspect 28, wherein at least one polynucleotide is comprised within a recombinant construct.

Aspect 33: The synthetic composition of Aspect 1 or Aspect 2, wherein at least one component is attached to a solid matrix.

Aspect 34: A synthetic composition comprising a target double-stranded DNA polynucleotide, a guide polynucleotide that is complementary to a sequence in the double-stranded DNA polynucleotide, and a Cas endonuclease at least 80% identical to a sequence selected from the group consisting of: SEQ ID NOs: 17, 18, 19, 20, 32, 33, 34, 35, 36, 37, and 38, or a functional fragment or variant thereof.

Aspect 35: A synthetic composition comprising a target double-stranded DNA polynucleotide, a polynucleotide encoding a guide polynucleotide that is complementary to a sequence in the double-stranded DNA polynucleotide, and a cas endonuclease gene at least 80% identical to a sequence selected from the group consisting of: SEQ ID NOs: 13, 14, 15, 16, 25, 26, 27, 28, 29, 30, and 31, or a functional fragment or variant thereof.

Aspect 36: A method for introducing a site-specific modification at a target sequence in the genome of a cell, comprising: introducing into the cell the synthetic composition from any of Aspects 1-35.

Aspect 37: A method of producing an organism with a modified genome, comprising: (a) introducing into at least one cell of the organism a heterologous composition comprising: i. a Cas-alpha endonuclease or a cas-alpha polynucleotide encoding a Cas-alpha endonuclease, ii. a guide polynucleotide comprising a variable targeting domain that is substantially complementary to a target sequence in the genome of the cell, wherein the guide polynucleotide and Cas-alpha endonuclease are capable of forming a complex that can recognize, bind to, and optionally nick or cleave the target sequence, iii. and a polynucleotide modification template comprising at least one region that is complementary to a PAM sequence adjacent to a DNA target sequence recognized by a Cas-alpha complex, wherein the at least one region that corresponds to a PAM sequence comprises at least one nucleotide mismatch; (b) incubating the cell, (c) generating a whole organism from the cell, and (d) verifying at least one nucleotide modification in the genome of at least one cell of the organism as compared to the target sequence of the genome of the cell prior to the introduction of the heterologous composition of (a).

Aspect 38: The method of Aspect 36 or 37, wherein the cell is a eukaryotic cell.

Aspect 39: The method of Aspect 38, wherein the eukaryotic cell is derived or obtained from an animal or a plant.

Aspect 40: The method of Aspects 39, wherein the plant is a monocot or a dicot.

Aspect 41: The method of Aspects 39, wherein the plant is selected from the group consisting of: maize, soybean, cotton, wheat, canola, oilseed rape, sorghum, rice, rye, barley, millet, oats, sugarcane, turfgrass, switchgrass, alfalfa, sunflower, tobacco, peanut, potato, *Arabidopsis*, safflower, and tomato.

Aspect 42: The method of Aspect 36 or 37, further comprising introducing a heterologous polynucleotide.

Aspect 43: The method of Aspect 42, wherein the heterologous polynucleotide is a donor DNA molecule.

Aspect 44: The method of Aspect 42, wherein the heterologous polynucleotide is a polynucleotide modification template that comprises a sequence at least 50% identical to a sequence in the cell.

Aspect 45: A progeny of the organism obtained by the method of Aspect 37, wherein the progeny retains the at least one nucleotide modification in at least one cell.

Aspect 46: A method of modifying a genomic sequence of a target cell, the method comprising providing a Cas endonuclease comprising an amino acid sequence that is at least 95% to 100% identical to one of SEQ ID NOS: 17, 18, 19, 20, 32, 33, 34, 35, 36, 37, and 38 and a guide polynucleotide that targets the genomic sequence of the target cell; and introducing a double-strand break in the genomic sequence of the target cell, thereby modifying the genomic sequence of the target cell.

While the invention has been particularly shown and described with reference to a preferred embodiment and various alternate embodiments, it will be understood by persons skilled in the relevant art that various changes in form and details can be made therein without departing from the spirit and scope of the invention. For instance, while the particular examples below may illustrate the methods and embodiments described herein using a specific target site or target organism, the principles in these examples may be applied to any target site or target organism. Therefore, it will be appreciated that the scope of this invention is encompassed by the embodiments of the inventions recited herein and in the specification rather than the specific examples that are exemplified below. All cited patents, applications, and publications referred to in this application are herein incorporated by reference in their entirety, for all purposes, to the same extent as if each were individually and specifically incorporated by reference.

EXAMPLES

The following are Examples of specific embodiments of some aspects of the invention. The Examples are offered for illustrative purposes only, and are not intended to limit the scope of the invention in any way. Efforts have been made to ensure accuracy with respect to numbers used (e.g., amounts, temperatures, etc.), but some experimental error and deviation should, of course, be allowed for.

Example 1: Identification and Characterization of Novel Class Cas-Alpha CRISPR-Cas Systems In this Example, methods for identifying novel Class 2 CRISPR (Clustered Regularly Interspaced Short Palindromic Repeats)-Cas (CRISPR associated) loci using identification of operon-like gene architecture and protein structural analyses are described.

First, arrays of CRISPRs were detected within microbial sequences using PILER-CR (Edgar, R. (2007) *BMC Bioinformatics*, 8:18) and MinCED (Bland, C. et al. (2007) *BMC Bioinformatics*, 8:209) software programs. Next, known CRISPR-Cas systems were removed from the dataset by searching the proteins encoded in the vicinity (20 kb 5' and 20 kb 3' (where possible)) of the CRISPR array for homology with known CRISPR associated (Cas) proteins utilizing a set of position specific scoring matrices (PSSMs) encompassing all known Cas protein families as described in Makarova, K. et al. (2015) *Nature Reviews Microbiology,* 13:722-736. To aid in the complete removal of known Class 2 CRISPR-Cas systems, multiple-sequence alignment of protein sequences from a collection of othologs from each family of Class 2 CRISPR-Cas endonucleases (e.g. Cas9, Cpf1 (Cas12a), C2c1 (Cas12b), C2c2 (Cas13), C2c3 (Cas12c)) was performed using MUSCLE (Edgar R. (2004) *Nucleic Acids Res.* 32:1792-1797). The alignments were examined, curated and used to build profile hidden Markov models (HMM) using HMMER (Eddy, S. R. (1998) *Bioinformatics.* 14:755-763; Eddy, S. R. (2011) *PLoS Comp. Biol.,* 7:e1002195). The resulting HMM models were then utilized to further identify and remove known Class 2 CRISPR-Cas systems from the dataset. Next, using PSSM specific searches as described above, the CRISPR loci that remained were evaluated for the presence of genes encoding proteins implicated as being important for spacer insertion and adaptation, Cas1 and Cas2 (Makarova, K. et al. (2015) *Nature Reviews Microbiology,* 13:722-736). CRISPR loci containing cas1 and cas2 genes were then selected and further examined to determine the proximity, order and directionality of the undefined genes encoded in the locus relative to the cas1 and cas2 genes and CRISPR array. Only those CRISPR loci forming an operon-like structure where a large (≥1500 bp open-reading frame) undefined gene was present close to and in the same transcriptional direction as the cas1 and cas2 genes were selected for further analysis. Next, the protein encoded in the undefined gene was analyzed for sequence and structural features indicative of a Class 2 endonuclease that is capable of cleaving DNA. First, depending on how much similarity existed between a candidate sequence and known proteins, various bioinformatics tools were employed to reveal its conserved functional features, from pairwise comparison, to family profile search, to structural threading, and to manually structural inspection. In general, homologous sequences for a new candidate protein were first collected by a PSI-BLAST (Altschul, S. F. et al. (1997) *Nucleic Acids Res.* 25:3389-3402) search against the National Center for Biotechnology Information (NCBI) non-redundant (NR) protein collection with cut-off e-value of 0.01. After redundancy reduction at ~90% identical level, groups of homologous sequences with various member inclusion thresholds (such as >60, 40, or 20% identity) were aligned to reveal conserved motifs by multiple-sequence alignment tools, MSAPRobs (Liu, Y. et. al. (2010) *Bioinformatics.* 26:1958-1964) and Clustalw. The most conserved homologous sequences underwent a sequence to family-profile search by HMMER (Eddy, S. R. (1998) *Bioinformatics.* 14: 755-763), against numerous domain databases including Pfam, Superfamily, and, SCOP (Murzin, A. G. et al. (1995) *J. Mol. Biol.* 247:536-540) and home-built structure-based profiles. Separately, the resulting candidate's homologous sequence alignment was also used to generate a candidate protein profile with addition of predicted secondary structures. The candidate profile was further used to do a profile-profile search by HHSEARCH (Soding, J. et al. (2006) *Nucleic Acids Res.* 34:W374-378), against pdb70_hhm and Pfam_hhm profile databases. In the next step, all detected sequence-structure relationships and the conserved motifs were threaded into a 3D structure template with MODELLER or manually mapped into the known structural reference on Discovery Studio (BIOVIA) and Pymol (Schrodinger). Finally, to verify and confirm the potential biological relevance as a Class 2 endonuclease, the catalytic or most conserved residues and key structural integrity were manually inspected and evaluated in light of the protein's biochemical function. Following structural identification of the key features indicative of a Class 2 endonuclease (e.g. DNA cleavage domain(s)), the other proteins encoded within the locus (5 kb 5' and 5 kb 3' from the ends of the newly defined CRISPR-Cas system (where possible)) were next examined for homology to known proteins families using InterProScan software (EMBL-EBI, UK) and through comparison with the NCBI NR protein collection using the BLAST program (Altschul, S. F. et al. (1990) *J. Mol. Biol.* 215:403-410). Genes encoding proteins with similarity (at least 30% identity) to known proteins were annotated as such in the CRISPR-Cas locus.

Initially, 4 novel Class 2 CRISPR-Cas system were identified from unknown microbes (Table 1). As shown in FIGS. 1A and B, encoded in each locus was an intact CRISPR-Cas system comprising all the components required for acquisition and interference. These included genes that together encoded proteins needed for acquiring and integrating spacers (Cas1, Cas2, and optionally Cas4) and a novel protein comprising a DNA cleavage domain, Cas-alpha (α), in an operon-like structure adjacent to a CRISPR array (Table 1).

TABLE 1

Novel Class 2 CRISPR-Cas Systems Cas-alpha (α) 1, 2, 3, and 4

| | | Cas1 | Cas2 | Cas4 | Casα SEQID NO | | Locus |
|---|---|---|---|---|---|---|---|
| Name | Organism | SEQID | SEQID | SEQID | Gene | Protein | SEQID NO |
| Casα1 | *Candidatus Micrarchaeota archaeon* | 1 | 5 | 9 | 13 | 17 | 21 |
| Casα2 | *Candidatus Micrarchaeota archaeon* | 2 | 6 | 10 | 14 | 18 | 22 |
| Casα3 | *Candidatus Aureabacteria bacterium* | 3 | 7 | 11 | 15 | 19 | 23 |
| Casα4 | Uncultured *Archaeon* | 4 | 8 | 12 | 16 | 20 | 24 |

Next, comparisons of the Cas-alpha endonucleases with the NCBI NR protein collection, using BLAST, followed by analysis with MinCED to find proteins that were near (≤5 kb) a CRISPR array, produced 7 additional CRISPR systems (Table 2). The locus gene architecture uncovered for these new proteins is shown in FIGS. 1C and 1D. The locus encoding Cas-alpha6 comprised intact cas1 and cas4 genes in addition to a partial cas1 gene (FIG. 1C) while Cas-alpha5, 7, 8, 9, 10, and 11 contained only the endonuclease gene adjacent to the CRISPR array (FIG. 1D). Loci for Cas-alphas 18 and 19 are depicted in FIG. 21A, with the mechanism of action depicted in FIG. 21B.

TABLE 2a

Cas-alpha (α) endonucleases 5-11

| Name | Organism | SEQID NO. Gene | SEQID NO. Protein | Locus SEQID NO. |
|---|---|---|---|---|
| Casα5 | Candidatus Micrarchaeota archaeon | 25 | 32 | 39 |
| Casα6 | Uncultured Archaeon | 26 | 33 | 40 |
| Casα7 | Parageobacillus thermoglucosidasius | 27 | 34 | 41 |
| Casα8 | Acidibacillus sulfuroxidans | 28 | 35 | 42 |
| Casα9 | Ruminococcus sp. | 29 | 36 | 43 |
| Casα10 | Syntrophomonas palmitatica | 30 | 37 | 44 |
| Casα11 | Clostridium novyi | 31 | 38 | 45 |

Structural examination of these proteins revealed that they were distinct from previously described Class 2 CRISPR-Cas endonucleases capable of double stranded DNA target recognition and cleavage. First, the size (422-613 amino acids) of the endonuclease was remarkably compact compared to other known Class 2 CRISPR-Cas systems. Second, the first amino (N)-terminal half of the protein was highly variable in sequence composition as evident by the lack of conservation of even a single amino acid (except a starting methionine). Despite this, secondary structure predictions (PSIPRED (Jones, J. T. (1999) *J. Mol. Biol.* 292:195-202)) indicated the presence of mixed beta-strands and alpha helices suggesting the presence of a Wedge-like (WED) or oligonucleotide binding domain (OBD) structure and Helical Bundle in the N-terminal region of all Cas-alpha proteins. In the carboxyl (C)-terminal half of the proteins, key catalytic residues and structures comprising a tri-split RuvC domain were conserved (FIG. 2). Additionally, all proteins contained a bridge-helix domain and a zinc-finger domain inserted between RuvC subdomains I-II and respectively (FIG. 2). It should be noted that additional zinc-finger-like motifs were detected in the Cas-alphas-1, 2, 3, 4, and 10 proteins. For Cas-alphas-1, 2, 3, and 4 a second zinc-finger motif was located near the N-terminus (e.g., amino acid positions 70-96 and 63-111 in Cas-alpha-1 and 2, respectively) (FIGS. 8A-D) while for Cas-alpha-10 two additional zinc-finger motifs were identified in the C-terminal half of the protein (FIG. 8J). Here, one of the extra zinc-finger domains was located in tandem with the first (Cas-alpha-10 amino acid positions 376-422) between RuvC II and III sub-domains and the third was found after RuvC sub-domain III (Cas-alpha-10 amino acid positions 466-482) (FIG. 8J). Examples of the Cas-alpha sequences and motifs recovered are shown in FIGS. 8A-K for Cas-alphas 1-11, respectively. FIG. 9 depicts how some of the Cas-alpha domains interact with the hybrid duplex target DNA/guide RNA, using the Cas12b (C2c1) protein backbone (PDB: 5wti) as a reference.

Sequence analysis of Cas-alphas 1 through 129, aligned with MUSCLE multiple sequence alignment, revealed unique motifs that are characteristic for Cas-alpha endonucleases, relative to the amino acid position numbers of SEQ ID NO:17 (Table: a Glycine (G) at position 337, a Glycine (G) at position 341, a Glutamic Acid (E) at position 430, a Leucine (L) at position 432, a Cysteine (C) at position 487, a Cysteine (C) at position 490, and/or a Cysteine (C) at position 507. A Cas-alpha endonuclease comprises the following motifs: GxxxG, ExL, $Cx_nC$, and $Cx_n(C,H)$ (wherein $x_n$=2-4 residues). A Cas-alpha endonuclease comprises one or more zinc finger domains. Table 2b includes some of the conserved motifs found in Cas-alpha endonucleases.

TABLE 2b

Cas-alpha (α) endonuclease conserved motifs

Motifs are described with the beginning amino acid (aa) position for each sequence (and end if >= 6 aa). x = any amino acid (n = any number, where applicable). G = Glycine, E = Glutamate, L = Leucine, C = Cysteine, H = Histidine.

| | | | | GxxxG | | ExL | | $Cx_nC$ | | $Cx_n(C,H)$ | |
|---|---|---|---|---|---|---|---|---|---|---|---|
| SEQID NO: | Cas-alpha # | Clade | Length | motif | aa start | motif | aa start | motif | aa start | motif | aa start |
| 17 | 1 | 1 | 544 | GVDIG | 337 | ENL | 430 | CSSC | 487 | CLNPTC | 507-512 |
| 18 | 2 | 1 | 586 | GIDRG | 365 | EDL | 471 | CSKC | 532 | CLKC | 550 |
| 19 | 3 | 1 | 603 | GIDRG | 380 | EDL | 481 | CAYC | 539 | CKLH | 564 |
| 20 | 4 | | 529 | GIDVG | 324 | ENL | 422 | CSKC | 475 | CEKC | 500 |
| 32 | 5 | 1 | 613 | GIDRG | 381 | EDL | 482 | CAYC | 540 | CLNPNC | 565-570 |
| 33 | 6 | | 500 | GLDVG | 284 | EDL | 382 | CSNPNC | 435-440 | CEKC | 462 |
| 34 | 7 | 7 | 424 | GVDLG | 224 | EDL | 325 | CSKC | 372 | CIEC | 391 |
| 35 | 8 | 7 | 422 | GIDLG | 223 | EDL | 324 | CSEC | 372 | CRAC | 391 |
| 36 | 9 | 6 | 440 | GVDVG | 229 | EKL | 330 | CSKC | 378 | CLEC | 397 |
| 37 | 10 | 6 | 497 | GVDLG | 226 | ENL | 327 | CSMC | 376 | CKQC | 395 |
| 38 | 11 | 6 | 497 | GVDLG | 290 | ELL | 390 | CSKC | 438 | CKKC | 457 |
| 254 | 12 | 6 | 461 | GVDLG | 271 | EKL | 371 | CSRC | 418 | CTKC | 437 |
| 255 | 13 | 6 | 448 | GIDLG | 223 | EDL | 333 | CNNC | 382 | CKVC | 404 |
| 256 | 14 | 6 | 430 | GIDVG | 216 | ENL | 328 | CSLC | 377 | CVVC | 399 |
| 257 | 15 | 6 | 436 | GVDLG | 229 | EDL | 330 | CSKC | 378 | CLKC | 397 |
| 258 | 16 | 6 | 402 | GVDLG | 214 | EQL | 314 | CSKC | 361 | CIKC | 380 |
| 259 | 17 | 6 | 493 | GIDIG | 230 | ENL | 386 | CSRC | 433 | CVNDEC | 455-460 |
| 260 | 18 | 6 | 398 | GVDLG | 205 | EKL | 305 | CSKC | 352 | CKEC | 371 |
| 261 | 19 | 6 | 433 | GVDLG | 231 | EDL | 332 | CSKC | 381 | CVKC | 400 |
| 262 | 20 | 6 | 482 | GVDLG | 275 | ELL | 375 | CSEC | 423 | CKRC | 442 |
| 263 | 21 | 6 | 482 | GVDLG | 275 | ELL | 375 | CSEC | 423 | CKRC | 442 |
| 264 | 22 | 6 | 424 | GIDVG | 223 | EDL | 324 | CCKC | 423 | CIDC | 390 |
| 265 | 23 | 2 | 451 | GIDLG | 237 | EDL | 328 | CSEC | 371 | CEKC | 398 |

TABLE 2b-continued

Cas-alpha (α) endonuclease conserved motifs

Motifs are described with the beginning amino acid (aa) position for each sequence (and end if >= 6 aa). x = any amino acid (n = any number, where applicable). G = Glycine, E = Glutamate, L = Leucine, C = Cysteine, H = Histidine.

| | | | | GxxxG | | ExL | | Cx$_n$C | | Cx$_n$(C,H) | |
|---|---|---|---|---|---|---|---|---|---|---|---|
| SEQID NO: | Cas-alpha # | Clade | Length | motif | aa start | motif | aa start | motif | aa start | motif | aa start |
| 266 | 24 | 7 | 451 | GIDMG | 231 | ELL | 332 | CSQC | 379 | CKQC | 398 |
| 267 | 25 | 6 | 451 | GIDLG | 226 | EDL | 336 | CNNC | 385 | CKVC | 407 |
| 268 | 26 | 6 | 437 | GIDLG | 225 | EDL | 335 | CSKC | 384 | CTVC | 403 |
| 269 | 27 | 6 | 440 | GVDVG | 229 | EKL | 330 | CSKC | 378 | CLEC | 397 |
| 270 | 28 | 6 | 439 | GVDVG | 229 | EKL | 330 | CSKC | 378 | CLKC | 397 |
| 271 | 29 | 6 | 402 | GVDLG | 214 | EQL | 314 | CSKC | 361 | CIKC | 380 |
| 272 | 30 | 7 | 493 | GLDLG | 278 | EYL | 378 | CSKC | 426 | CKSC | 445 |
| 273 | 31 | 6 | 421 | GVDMG | 230 | EKL | 330 | CSEC | 377 | CLEC | 396 |
| 274 | 32 | 6 | 421 | GVDMG | 230 | EKL | 330 | CSEC | 377 | CLEC | 396 |
| 275 | 33 | | 507 | GIDVG | 284 | EDL | 382 | CSNPSC | 435-440 | CEKC | 462 |
| 276 | 34 | | 541 | GIDRG | 347 | EKL | 437 | CSHC | 492 | CNKC | 514 |
| 277 | 35 | | 537 | GIDRG | 342 | EEL | 432 | CSHC | 487 | CNKC | 509 |
| 278 | 36 | | 534 | GIDRG | 338 | EKL | 428 | CSHC | 483 | CNKC | 505 |
| 279 | 37 | | 726 | GIDFG | 402 | EDL | 509 | CSKC | 563 | CEFC | 602 |
| 280 | 38 | | 777 | GIDRG | 448 | ESL | 549 | CAKC | 609 | CSVH | 739 |
| 281 | 39 | | 610 | GIDRG | 304 | EKL | 405 | CAKC | 465 | CMKH | 579 |
| 282 | 40 | | 564 | GIDAG | 351 | EKL | 454 | CSHC | 509 | CGKC | 537 |
| 283 | 41 | | 610 | GIDRG | 401 | EQL | 492 | CSHC | 547 | CNKC | 579 |
| 284 | 42 | 6 | 327 | GVDLG | 137 | EKL | 237 | CSRC | 284 | CTKC | 303 |
| 285 | 43 | 2 | 364 | GIDLG | 150 | EDL | 241 | CSEC | 292 | CEKC | 311 |
| 286 | 44 | 6 | 366 | GVDLG | 156 | ELL | 256 | CSKC | 304 | CKKC | 323 |
| 287 | 45 | 6 | 401 | GVDMG | 210 | EKL | 310 | CSEC | 357 | CLEC | 376 |
| 288 | 46 | 6 | 401 | GVDMG | 210 | EKL | 310 | CSEC | 357 | CLEC | 376 |
| 289 | 47 | 6 | 401 | GVDMG | 210 | EKL | 310 | CSEC | 357 | CLEC | 376 |
| 290 | 48 | 6 | 401 | GVDMG | 210 | EKL | 310 | CSEC | 357 | CLEC | 376 |
| 291 | 49 | 6 | 401 | GVDMG | 210 | EKL | 310 | CSEC | 357 | CLEC | 376 |
| 292 | 50 | 6 | 404 | GVDMG | 213 | EKL | 313 | CSEC | 360 | CLEC | 379 |
| 293 | 51 | 6 | 404 | GVDMG | 213 | EKL | 313 | CSEC | 360 | CLEC | 379 |
| 294 | 52 | 6 | 404 | GVDMG | 213 | EKL | 313 | CSEC | 360 | CLEC | 379 |
| 295 | 53 | 6 | 404 | GVDMG | 213 | EKL | 313 | CSEC | 360 | CLEC | 379 |
| 296 | 54 | 6 | 404 | GVDMG | 213 | EKL | 313 | CSEC | 360 | CLEC | 379 |
| 297 | 55 | 6 | 407 | GVDLG | 219 | EQL | 319 | CSKC | 366 | CIKC | 385 |
| 298 | 56 | 6 | 421 | GVDMG | 230 | EKL | 330 | CSEC | 377 | CLEC | 396 |
| 299 | 57 | 7 | 422 | GVDLG | 224 | EDL | 325 | CSKC | 372 | CKSC | 391 |
| 300 | 58 | 7 | 424 | GVDLG | 224 | EDL | 325 | CSKC | 372 | CIEC | 391 |
| 301 | 59 | 7 | 427 | GVDLG | 229 | EDL | 330 | CSKC | 379 | CKGC | 397 |
| 302 | 60 | 6 | 428 | GVDLG | 216 | EDL | 326 | CSIC | 373 | CINC | 395 |
| 303 | 61 | 6 | 433 | GVDLG | 231 | EDL | 332 | CSKC | 381 | CVKC | 400 |
| 304 | 62 | 7 | 438 | GIDLG | 224 | ELL | 319 | CSQC | 366 | CKQC | 385 |
| 305 | 63 | 6 | 439 | GVDLG | 228 | EDL | 328 | CSCC | 378 | CKNPEC | 397-402 |
| 306 | 64 | 6 | 440 | GVDVG | 229 | EKL | 330 | CSKC | 378 | CLKC | 397 |
| 307 | 65 | 6 | 441 | GIDLG | 226 | EDL | 336 | CSKC | 385 | CVIC | 407 |
| 308 | 66 | 7 | 443 | GIDMG | 223 | EDL | 324 | CSEC | 371 | CQQC | 390 |
| 309 | 67 | 6 | 444 | GIDLG | 226 | ENL | 336 | CNRC | 385 | CVVC | 407 |
| 310 | 68 | 7 | 445 | GIDLG | 231 | ELL | 329 | CSQC | 373 | CKQC | 392 |
| 311 | 69 | 7 | 445 | GIDLG | 231 | ELL | 326 | CSQC | 373 | CKQC | 392 |
| 312 | 70 | 7 | 445 | GIDLG | 231 | ELL | 326 | CSQC | 373 | CKQC | 392 |
| 313 | 71 | 7 | 445 | GIDLG | 231 | ELL | 326 | CSQC | 373 | CKQC | 392 |
| 314 | 72 | 7 | 447 | GIDMG | 246 | EEL | 348 | CSEC | 395 | CLSC | 417 |
| 315 | 73 | 6 | 447 | GIDLG | 224 | EDL | 334 | CSKC | 383 | CIIC | 405 |
| 316 | 74 | 5 | 449 | GIDLG | 251 | ESL | 354 | CSQC | 400 | CNKC | 418 |
| 317 | 75 | 7 | 450 | GIDMG | 230 | EDL | 331 | CSEC | 378 | CQQC | 397 |
| 318 | 76 | 7 | 450 | GIDMG | 230 | EDL | 331 | CSEC | 378 | CQQC | 397 |
| 319 | 77 | 7 | 450 | GIDMG | 230 | EDL | 331 | CSEC | 378 | CQQC | 397 |
| 320 | 78 | 6 | 450 | GIDLG | 229 | EDL | 339 | CSKC | 388 | CKVC | 410 |
| 321 | 79 | 7 | 451 | GIDMG | 231 | ELL | 332 | CSQC | 379 | CKQC | 398 |
| 322 | 80 | 7 | 451 | GIDMG | 231 | ELL | 332 | CSQC | 379 | CKQC | 398 |
| 323 | 81 | 7 | 451 | GIDMG | 231 | ELL | 332 | CSQC | 379 | CKQC | 398 |
| 324 | 82 | 7 | 451 | GIDLG | 231 | ELL | 332 | CSQC | 379 | CKQC | 398 |
| 325 | 83 | 7 | 451 | GIDMG | 231 | ELL | 332 | CSQC | 379 | CKQC | 398 |
| 326 | 84 | 7 | 451 | GIDMG | 231 | ELL | 332 | CSQC | 379 | CKQC | 398 |
| 327 | 85 | 7 | 451 | GIDMG | 231 | ELL | 332 | CSQC | 379 | CKQC | 398 |
| 328 | 86 | 7 | 451 | GIDMG | 231 | ELL | 332 | CSQC | 379 | CKQC | 398 |
| 329 | 87 | 7 | 451 | GIDMG | 231 | ELL | 332 | CSQC | 379 | CKQC | 398 |
| 330 | 88 | 7 | 451 | GIDMG | 231 | ELL | 332 | CSQC | 379 | CKQC | 398 |
| 331 | 89 | 7 | 451 | GIDMG | 231 | ELL | 332 | CSQC | 379 | CKQC | 398 |
| 332 | 90 | 7 | 451 | GIDMG | 231 | ELL | 332 | CSQC | 379 | CKQC | 398 |

TABLE 2b-continued

Cas-alpha (α) endonuclease conserved motifs

Motifs are described with the beginning amino acid (aa) position for each sequence (and end if >= 6 aa). x = any amino acid (n = any number, where applicable). G = Glycine, E = Glutamate, L = Leucine, C = Cysteine, H = Histidine.

| SEQ ID NO: | Cas-alpha # | Clade | Length | GxxxG motif | aa start | ExL motif | aa start | $Cx_nC$ motif | aa start | $Cx_n(C,H)$ motif | aa start |
|---|---|---|---|---|---|---|---|---|---|---|---|
| 333 | 91 | 7 | 451 | GIDMG | 231 | ELL | 332 | CSQC | 379 | CKQC | 398 |
| 334 | 92 | 7 | 451 | GIDMG | 231 | ELL | 332 | CSQC | 379 | CKQC | 398 |
| 335 | 93 | 7 | 451 | GIDMG | 231 | ELL | 332 | CSQC | 379 | CKQC | 398 |
| 336 | 94 | 7 | 451 | GIDMG | 231 | ELL | 332 | CSQC | 379 | CKQC | 398 |
| 337 | 95 | 7 | 453 | GIDMG | 233 | EDL | 332 | CSEC | 381 | CQQC | 400 |
| 338 | 96 | 7 | 453 | GIDMG | 233 | EDL | 334 | CSEC | 381 | CQQC | 400 |
| 339 | 97 | 7 | 453 | GIDMG | 233 | EDL | 334 | CSEC | 381 | CQQC | 400 |
| 340 | 98 | 7 | 453 | GIDMG | 233 | EDL | 334 | CSEC | 381 | CQQC | 400 |
| 341 | 99 | 7 | 453 | GIDMG | 233 | EDL | 334 | CSEC | 381 | CQQC | 400 |
| 342 | 100 | 7 | 453 | GIDMG | 233 | ENL | 334 | CSEC | 381 | CQQC | 400 |
| 343 | 101 | 4 | 453 | GVDLG | 252 | ESL | 350 | CHVC | 406 | CTNPEC | 423-428 |
| 344 | 102 | 4 | 453 | GVDLG | 252 | ESL | 350 | CHVC | 406 | CTNPEC | 423-428 |
| 345 | 103 | 6 | 461 | GVDLG | 271 | EKL | 371 | CSRC | 418 | CTKC | 437 |
| 346 | 104 | 6 | 461 | GVDLG | 271 | EKL | 371 | CSRC | 418 | CTKC | 437 |
| 347 | 105 | 6 | 461 | GVDLG | 271 | EKL | 371 | CSRC | 418 | CTKC | 437 |
| 348 | 106 | 6 | 461 | GVDLG | 271 | EKL | 371 | CSRC | 418 | CTKC | 437 |
| 349 | 107 | 6 | 461 | GVDLG | 271 | EKL | 371 | CSRC | 418 | CTKC | 437 |
| 350 | 108 | 6 | 461 | GVDLG | 271 | EKL | 371 | CSRC | 418 | CTKC | 437 |
| 351 | 109 | 6 | 461 | GVDLG | 271 | EKL | 371 | CSRC | 418 | CTKC | 437 |
| 352 | 110 | 9 | 463 | GIDIG | 244 | EKL | 347 | CSKC | 395 | CQVC | 419 |
| 353 | 111 | 8 | 464 | GIDLG | 228 | EDL | 329 | CSRC | 376 | CREC | 395 |
| 354 | 112 | 7 | 471 | GVDLG | 265 | EFL | 393 | CSKC | 411 | CKSC | 430 |
| 355 | 113 | 4 | 471 | GVDLG | 268 | ESL | 367 | CSYC | 423 | CTNPQC | 440-445 |
| 356 | 114 | 6 | 477 | GVDLG | 286 | EKL | 386 | CSKC | 433 | CKKC | 452 |
| 357 | 115 | 7 | 478 | GVDLG | 265 | EFL | 365 | CSKC | 413 | CKSC | 432 |
| 358 | 116 | 7 | 478 | GVDLG | 265 | EFL | 365 | CSKC | 413 | CKSC | 432 |
| 359 | 117 | 6 | 482 | GVDLG | 275 | ELL | 375 | CSEC | 423 | CKRC | 442 |
| 360 | 118 | 6 | 482 | GVDLG | 275 | ELL | 375 | CSEC | 423 | CKRC | 442 |
| 361 | 119 | 6 | 482 | GVDLG | 275 | ELL | 375 | CSEC | 423 | CKRC | 442 |
| 362 | 120 | 2 | 486 | GIDLG | 256 | ERL | 382 | CPSC | 429 | CPEC | 451 |
| 363 | 121 | 7 | 489 | GVDLG | 278 | EEL | 378 | CSKC | 426 | CKNKEC | 445-450 |
| 364 | 122 | 6 | 491 | GVDLG | 275 | EYL | 374 | CHIC | 433 | CKAC | 452 |
| 365 | 123 | 4 | 492 | GVDLG | 289 | ESL | 388 | CSYC | 444 | CTNPQC | 461-466 |
| 366 | 124 | 7 | 496 | GVDLG | 265 | EFL | 365 | CSKC | 413 | CKSC | 432 |
| 367 | 125 | 7 | 496 | GVDLG | 265 | EFL | 365 | CSKC | 413 | CKSC | 432 |
| 368 | 126 | 6 | 497 | GVDLG | 290 | ELL | 390 | CSKC | 438 | CKKC | 457 |
| 369 | 127 | 4 | 497 | GVDLG | 293 | ESL | 392 | CSYC | 448 | CTNPQC | 465-470 |
| 370 | 128 | 6 | 536 | GVNLG | 305 | ENL | 405 | CSIC | 452 | CKDPNC | 471-476 |
| 371 | 129 | 2 | 543 | GVDLG | 253 | EDL | 363 | CPSC | 412 | CPVC | 434 |

Example 2: Cas-Alpha Guide RNA Solutions

In this Example, methods for determining the guide RNA(s) that support double stranded DNA target recognition and cleavage for a novel group of class 2 CRISPR (Clustered Regularly Interspaced Short Palindromic Repeat)-Cas (CRISPR associated) endonucleases, Cas-alpha, are described.

One method relies on computational prediction to determine the sRNA(s) needed to form a functional complex with a Cas-alpha endonuclease. Briefly, the CRISPR array may be utilized to generate CRISPR RNA(s) (crRNA(s)) accounting for both possible transcriptional directions of the CRISPR array and various configurations of the repeat and spacer (e.g. repeat:spacer, spacer:repeat or repeat:spacer:repeat) that may be preferred by the endonuclease. Additionally, a trans-encoding CRISPR associated RNA(s) (tracrRNA(s)) may be computationally identified in the locus as described in Karvelis, T. et al. (2015) *Genome Biology.* 16:253. Briefly, an alignment may be performed between the CRISPR repeat consensus sequence with the locus sequence using BLAST or manually by hand. Regions of homology (separate from the CRISPR array) may then be examined by analyzing the possible transcriptional directions of the putative tracrRNA(s) for secondary structures and possible termination signals present in an RNA version of the sense and anti-sense genomic DNA sequences surrounding the anti-repeat. The tracrRNA(s) may then be duplexed with various crRNA predictions or engineered to form a chimeric non-natural single guide RNA(s) (sgRNA(s)). crRNA(s), tracrRNA(s) and sgRNA(s) may be synthesized (IDT equivalent) or T7 transcribed with the TranscriptAid T7 High Yield Transcription Kit (Thermo Fisher Scientific) or equivalent for further experimentation.

Another method is reliant on the sequencing of small RNAs (sRNA-seq) that are produced from the novel Class 2 CRISPR-Cas locus. This may be performed similar to the method described in Zetsche, B. et al. (2015) *Cell.* 163:1-13. Briefly, the CRISPR-Cas locus is placed onto an *E. coli* plasmid DNA, subsequent cultures containing the plasmid borne CRISPR-Cas locus are harvested by centrifugation, total RNA extracted using TRIzol Max Bacterial Isolation Kit (Thermo Fisher Scientific), small RNAs isolated using the mirVana miRNA Isolation Kit (Thermo Fisher Scientific) and libraries prepared for sequencing using the TruSeq Small RNA Library Prep Kit (Illumina). Expression of the locus can be boosted using known *E. coli* promoters. Following sequencing on a MiSeq instrument (Illumina) or equivalent, the resulting sequence data is mapped (Bowtie 2 software (Langmead, B. et al. (2012) *Nat. Methods.* 9:357-359) or equivalent) back to the locus to determine the transcriptional and maturation patterns of the sRNA(s) encoded in the locus.

Another method is reliant on the sequencing of small RNAs (sRNA-seq) that are co-purified with the Cas-alpha protein from the novel Class 2 CRISPR-Cas locus. This may be performed similar to the method described in Sinkunas, T. et al. (2013) *EMBO J.* 32:385-394 except Illumina deep sequencing may be employed to determine the sequence of the small RNA(s) needed to direct double stranded DNA target recognition and cleavage. Briefly, the CRISPR-Cas locus is placed onto an *E. coli* plasmid DNA. The Cas-alpha gene in the locus can be modified to also encode a protein purification tag. For example but not limited to a histidine (His), streptavidin (Strep), and/or maltose binding protein (MBP) tag. Alternatively, a "solo" Cas-alpha expression cassette encoding a His, Strep, and/or MBP tagged version of the Cas-apha protein can be co-transformed with the plasmid borne locus. Next, the plasmid(s) are transformed into *E. coli* (for example but not limited to Artic Express (DE3) (ThermoFisher Scientific) and then cultures are harvested by centrifugation. The cells are then lysed and tagged Cas-alpha protein purified by chromatography. Finally, small RNAs bound to the Cas-alpha protein are extracted using TRIzol Max Bacterial Isolation Kit (Thermo Fisher Scientific) or other suitable method and processed as described above.

The crRNA, tracrRNA, and sgRNA solutions are listed in Table 3 for select Cas-alpha systems described herein.

TABLE 3

Cas-alpha (α) guide RNA solutions

| Name | Repeat Consensus (SEQ ID NO.) | crRNA (SEQ ID NO.) | tracrRNA (SEQ ID NO.) | sgRNA (SEQ ID NO.) |
|---|---|---|---|---|
| Casα1 | 46 | 57 | 60, 61, 62, 63 | 69, 70, 71, 72 |
| Casα2 | 47 | 58 | 64, 65, 66, 67, 185, 186, 187 | 73, 74, 75, 76, 208, 209 |
| Casα3 | 48 | 177 | — | — |
| Casα4 | 49 | 59 | 68 | 77 |
| Casα5 | 50 | 178 | — | — |
| Casα6 | 51 | 179 | 188, 189, 190, 191 | 211, 212, 213, 214 |
| Casα7 | 52 | 180 | 192, 193 | 215, 216, 217 |
| Casα8 | 53 | 181 | 194, 195, 196 | 218, 219, 220, 221 |
| Casα9 | 54 | 182 | 197, 198 | 222, 223, 224 |
| Casα10 | 55 | 183 | 199, 200, 201, 202, 203 | 225, 226, 227, 228, 229 |
| Casα11 | 56 | 184 | 204, 205, 206, 207 | 230, 231, 232, 233, 234 |

Example 3: Bacterial Cas-Alpha Expression Plasmids

In this Example, plasmid DNA expression constructs are generated to examine Cas-alpha double stranded DNA target recognition and cleavage in a heterologous host, *E. coli*.

First, the CRISPR array of a native Cas-alpha CRISPR-Cas locus (FIG. 1) (SEQ ID NO:21) encoding the first Cas-alpha endonuclease examine herein, Cas-alpha1 (SEQ ID NO:17, was modified. This was accomplished by reducing the number of CRISPR units (repeat (SEQ ID NO:46): spacer:repeat (SEQ ID NO:46)) to three. Next, the spacer sequence between the repeats was replaced with a sequence (SEQ ID NO:78) capable of base pairing with the anti-sense strand of a double stranded target sequence, T2, adjacent to a 7 bp region of randomization from the plasmid DNA PAM library described in Karvelis et al., 2015. The resulting "complete" CRISPR-Cas locus engineered to target T2 (SEQ ID NO:79) (FIG. 3), was then synthesized (GenScript) directly into a low copy *E. coli* plasmid DNA (pACYC184, NEB) resulting in plasmid DNA R-225. It should be noted that during the synthesis process a single nucleotide polymorphism (SNP) was introduced into the casa1 gene but that the SNP (C to A bp at position 1284 of the gene) was silent and did not alter the amino acid composition of Casa1. To enhance expression of the modified Cas-alpha CRISPR-Cas locus, it was also cloned into pETduet-1 (Millipore Sigma) modified to contain a single isopropyl β-D-1-thiogalactopyranoside (IPTG) inducible T7 promoter, resulting in plasmid DNA R-652. Next, to confirm that double stranded DNA target cleavage activity required Casa1, its gene (SEQ ID NO:13) was removed from plasmid R-652 yielding plasmid DNA R-658. To confirm the minimal components required for double strand DNA target recognition and cleavage, the adaptation genes (cas1, 2, and 4) and the region 3' of the modified CRISPR array were removed from R-652, producing a "minimal" locus (SEQ ID NO:80) (as exemplified in FIG. 3) expression plasmid resulting in plasmid R-657.

For other Cas-alpha endonucleases, a plasmid DNA expression cassette encoding a "minimal" locus modified to target T2 (FIG. 3) (the equivalent of R-657 for Cas-alpha1) was synthesized (GenScript) into pETduet-1 to assay for dsDNA target recognition and cleavage. Additionally, a "solo" cas-alpha gene fused to the 3' end of a sequence encoding a histidine (HIS) tag (10×-HIS SEQ ID NO:81 or 6×-HIS SEQ ID NO:82), maltose binding protein (MBP) tag (SEQ ID NO:83), and tobacco etch virus cleavage site (TEV) (SEQ ID NO:84) was constructed by methods known in the art (FIG. 3). Native cas-alpha gene sequences or *E. coli* codon optimized versions were utilized. For optimized genes, codon conditioning was carried out using *E. coli* codon tables, genes adjusted for ideal GC content, and repetitive sequences and gene destabilizing features removed where possible. Finally, the tagged "solo" cas-alpha genes were cloned into either a Tetracycline (TET), IPTG, or arabinose inducible plasmid DNA expression cassettes by methods known in the art.

Example 4: Cas-Alpha Protein Expression and Purification

In this Example, a method to recombinantly expression and purify Cas-alpha endonucleases are described.

Cas-alpha protein was expressed and purified using a tagged "solo" protein expression plasmid as described in Example 3. First, the expression construct was transformed into either *E. coli* BL21(DE3) or ArcticExpress (DE3)

strains and cultures were grown in LB broth supplemented with selective agent (e.g. ampicillin (100 μg/ml)). After culturing to an $OD_{600}$ of 0.5, temperature was decreased to 16° C. and expression induced with IPTG (0.5 mM) or arabinose (0.2% (w/v)). After 16 h, cells were pelleted and re-suspended in loading buffer (20 Tris-HCl, pH 8.0 at 25° C., 1.5 M NaCl, 5 mM 2-mercaptoethanol, 10 mM imidazole, 2 mM PMSF, 5% (v/v) glycerol) and disrupted by sonication. Cell debris was removed by centrifugation. The supernatant was loaded on the $Ni^{2+}$-charged HiTrap chelating HP column (GE Healthcare) and eluted with a linear gradient of increasing imidazole concentration (from 10 to 500 mM) in 20 Tris-HCl, pH 8.0 at 25° C., 0.5 M NaCl, 5 mM 2-mercaptoethanol buffer. The fractions containing Cas-alpha were pooled and subsequently loaded on a HiTrap heparin HP column (GE Healthcare) for elution using a linear gradient of increasing NaCl concentration (from 0.1 to 1.5 M). The next fractions containing Cas-alpha protein were pooled and the tag was cleaved by overnight incubation with TEV protease at 4° C. To remove cleaved His-MBP-tag and TEV protease, reaction mixtures were loaded onto a HiTrap heparin HP 5 column (GE Healthcare) for elution using a linear gradient of increasing NaCl concentration (from 0.1 to 1.5 M). Next, the elution from the HiTrap columns was loaded on a MBPTrap column (GE Healthcare) and Cas-alpha protein was collected as flow though. The collected fractions were then dialyzed against 20 mM Tris-HCl, pH 8.0 at 25° C., 500 mM NaCl, 2 mM DTT, and 50% (v/v) glycerol and stored at −20° C.

Example 5: Methods to Detect Cas-Alpha Double Stranded DNA Target Recognition and Cleavage In this Example, methods to detect double strand DNA target recognition and cleavage by Cas-alpha endonucleases are described.

Lysate Assay

The detection of double stranded DNA target recognition and cleavage was carried-out using cell lysates expressing a Cas-alpha endonuclease as shown in FIG. 3. First, a plasmid DNA encoding a Cas-alpha endonuclease either by itself or as part of a Cas-alpha CRISPR-Cas locus modified to target the T2 sequence (see Example 3) was transformed into E. coli cells (e.g., DH5α (Thermo Fisher Scientific), ArcticExpress (DE3) (Agilent Technologies), or NEB Stable (NEB)) by methods known in the art. Next, cell cultures carrying the gene encoding the Cas-alpha endonuclease were cultured to an optical density (OD) of 0.5 (using a wavelength of 600 nm) in Luria broth (LB) media containing a suitable antibiotic (e.g., ampicillin) (FIG. 3 Step I). For plasmids that required an inducing agent to stimulate expression (e.g., R-652), the temperature was decreased to 16° C., and expression initiated with inducing agent (e.g., 1 mM isopropyl β-D-1-thiogalactopyranoside (IPTG)) for 16 h. If no induction was required, cells were immediately harvested after reaching an $OD_{600}$ of 0.5. Next, cells were pelleted by centrifugation (at 3,000 g for 5 min at 4° C.), media poured-off, and resuspended in 1 ml of lysis buffer (20 mM phosphate, pH 7.0, 0.5 M NaCl, 5% (v/v) glycerol) supplemented with 10 μl PMSF and transferred to ice. The cells were then disrupted by sonication for 2 min (6 s pulse followed by 3 s pause) and cell debris removed by centrifugation at 14,000 g for 30 min at 4° C. Next, for Cas-alpha proteins expressed as a solo component, 20 μl of supernatant containing the soluble Cas-alpha protein was immediately combined with 2 μg of the T7 transcribed guide RNA(s) in the presence of 1 μl (40 U) of RiboLock RNase Inhibitor (Thermo Fisher Scientific) and incubated for 15 min at room temperature (FIG. 3 Step II). If the Cas-alpha endonuclease and guide RNAs were expressed together from the plasmid borne CRISPR-Cas locus, the clarified lysate containing Cas-alpha guide RNA ribonucleoprotein complexes was not processed any further but used directly in the next step (FIG. 3 Step II). Digestion of a randomized PAM library was then performed by gently combining 10 μl of the Cas-alpha guide RNA lysate mixture with 90 μl of reaction buffer (10 mM Tris-HCl, pH 7.5 at 37° C., 100 mM NaCl and 1 mM DTT, 10 mM MgCl2) and 1 μg of the 7 bp randomized PAM library from Karvelis et al. 2015 containing a T2 target sequence (FIG. 3 Step III). Alternatively, if the PAM sequence was known, 10 μl of the Cas-alpha guide RNA lysate mixture was combined with 1 μg of plasmid DNA containing a fixed target sequence. After 1 h at 37° C., reactions were subject to DNA end-repaired by incubating them with 1 μl (5 U) of T4 DNA polymerase and 1 μl of 10 mM dNTP mix (Thermo Fisher Scientific) for 20 min at 11° C. The reaction was then inactivated by heating it to 75° C. for 10 min. To efficiently capture free DNA ends by adapter ligation, a 3'-dA overhang was added by incubating the reaction mixture with 1 μl (5 U) of DreamTaq polymerase (Thermo Fisher Scientific, EP0701) for 30 min at 72° C. Excess RNA was then removed from the reaction by incubating 1 μl of RNase A/T1 (Thermo Fisher Scientific) for 30 min at 37° C. The resulting DNA was then purified using a GeneJet PCR Purification Kit (Thermo Fisher Scientific).

Next, an adapter with a 3'-dT overhang was prepared by annealing A1 (5'-CGGCATTCCTGCTGAACCGCTCTTCCGATCT-3' (SEQ ID NO:85)) and phosphorylated A2 (5'-GATCGGAAGAGCGGTTCAGCAGGAATGCCG-3' (SEQ ID NO:86)) oligonucleotides by heating an equimolar mixture of the two for 5 min at 95° C. and slowly cooling (~0.1° C./s) to room temperature in Annealing (A) buffer (10 mM Tris-HCl, pH 7.5 at 37° C., 50 mM NaCl). The adapter was then ligated to the end repaired 3'-dA overhanging cleavage products by combining 100 ng of it and the adapter with 5 U of T4 Ligase (Thermo Fisher Scientific) in 25 μl of ligation buffer (40 mM Tris-HCl, pH 7.8 at 25° C., 10 mM MgCl2, 10 mM DTT, 0.5 mM ATP, 5% (w/v) PEG 4000) and allowing the reaction to proceed for 1 h at room temperature (FIG. 3 Step IV).

Next, the cleaved products containing the PAM sequence were enriched using R0 (5'-GCCAGGGTTTTCCCAGTCACGA-3' (SEQ ID NO:87)) and the A1 oligonucleotide specific to the 7 bp PAM library and adapter, respectively (FIG. 3 Step V). PCR was performed with Phusion High-Fidelity PCR Master Mix with high fidelity (HF) Buffer (Thermo Fisher Scientific) using 10 μl of the ligation reaction as template. A two-step amplification protocol (98° C.—30 s initial denaturation, 98° C.—15 s, 72° C.—30 s denaturation, annealing and synthesis for 15 cycles and 72° C.—5 min for final extension) was used. For the samples assembled in the absence of a Cas-alpha, PCR was performed using the R0 and the C0 primer (5'-GAAATTCTAAACGCTAAAGAGGAAGAGG-3' (SEQ ID NO:88)) pair with C0 being complementary to protospacer sequence. Next, the amplification products (148 bp and 145 bp for A1/R0 and C0/R0 primer pairs, respectively) were purified using a GeneJet PCR Purification Kit (Thermo Fisher Scientific).

Next, the sequences and indexes required for Illumina deep sequencing were incorporated onto the ends of the Cas-alpha cleaved DNA fragments and the resulting products deep sequenced (FIG. 3 Step VI). This was accomplished through two rounds of PCR using Phusion High-Fidelity PCR Master Mix in HF buffer (New England Biolabs) per the manufacturer's instruction. The primary PCR was assembled using 20 ng of Cas-alpha cleaved adapter ligated PAM-sided template and allowed to proceed for 10 cycles. The reaction uses a forward primer, F1 (5'-CTACACTCTTTCCCTACACGACGCTCTTCC-GATCTAAGGCGGC-ATTCCTGCTGAAC-3' (SEQ ID NO:89)) that can hybridize to the adapter and a reverse primer, R1 (5'-CAAGCAGAAGACGGCAT-ACGAGCTCTTCCGATCTCGGCGACGTTGGGTC-3' (SEQ ID NO:90)), that binds to a site 3' of the region of PAM randomization. In addition to hybridizing to the adapter ligated PAM fragment, the primers also contain Illumina sequences extending off their 5' ends. For the forward primer, the extra sequence includes a portion of the sequence required for bridge amplification (5'-CTACACTCTTTCCC-TACACGACGC-TCTTCCGATCT-3' (SEQ ID NO:91)) followed by an interchangeable unique index sequence (5'-AAGG-3') that permits multiple amplicons to be deconvoluted if sequenced simultaneously. For the reverse primer, the additional sequence is comprised only of that required for bridge amplification at the 3' end of the amplicon (5'-CAAGCAGAAGACGGCATACGAGCTC-TTCC-GATCT-3' (SEQ ID NO:92)). The following PCR cycling conditions were used: 95° C.—30 s initial denaturation, 95° C.—10 s, 60° C.—15 s, 72° C.—5 s denaturation, annealing and synthesis for 10 cycles and 72° C.—5 min for final extension. Following primary PCR, a second round of PCR amplification was performed using 2 µl (in total volume of 50 µl) of the first round PCR as template. The forward primer, F2 (5'-AATGATACGGCGACCACCGAGATCTA-CACTCTTT-CCCTACACG-3' (SEQ ID NO:93)), used in the secondary PCR hybridizes to the 5' region of F1 further extending the sequences required for Illumina deep sequencing. The reverse primer, R2 (5'-CAAGCAGAAGACGG-CATA-3' (SEQ ID NO:94)), used in the secondary PCR simply binds to the 3' end of the primary PCR amplicon. The following PCR cycling conditions were used: 95° C.—30 s initial denaturation, 95° C. —10 s, 58° C.—15 s, 72° C.—5 s denaturation, annealing and synthesis for 10 cycles and 72° C.—5 min for final extension. Following library creation, amplifications were purified with a QIAquick PCR Purification Kit (Qiagen) per the manufacturer's instruction and combined into a single sample in an equimolar concentration. Next, the libraries were single-read deep sequenced on a MiSeq Personal Sequencer (Illumina) with a 25% (v/v) spike of PhiX control v3 (Illumina) and sequences post-processed and deconvoluted per the manufacture's instruction. Note the original PAM library was also sequenced as a control to account for inherent bias that would affect downstream PAM analyses. This is carried out as described above except the forward primer in the primary PCR, C1 (5'-CTACACTCTTTCCCTACACGACGCTCTTCC-GATCTGGAATAAACGCTAAAGAGGAAG AGG-3' (SEQ ID NO:95)), is used instead of F1 as it hybridizes directly to the protospacer region in the uncut PAM library.

Next, evidence of double stranded DNA target recognition was evaluated by searching for the presence of a PAM in the Cas-alpha cleaved fragments. This was accomplished by first generating a collection of sequences representing all possible outcomes of double stranded DNA cleavage and adapter ligation within the target region. For example, cleavage and adapter ligation at just after the $21^{st}$ position of the target would produce the following sequence (5'-CCGCTCTTCCGATCTGCCGGCGACGTTGGGT-CAACT-3' (SEQ ID NO:96)) where the adapter and target sequences comprise 5'-CCGCTCTTCCGATCT-3' (SEQ ID NO:97) and 5'-GCCGGCGACGTTGGGTCAACT-3' (SEQ ID NO:98), respectively. Next, these sequences were searched for in the sequence datasets along with a 10 bp sequence 5' of the 7 bp PAM region (5'-TGTCCTCTTC-3' (SEQ ID NO:99)). Once identified, the intervening PAM sequence was isolated by trimming away the 5' and 3' flanking sequences. Next, the frequency of the extracted PAM sequences was normalized to the original PAM library to account for bias inherent to the initial library. First, identical PAM sequences were enumerated, and frequency calculated versus the total reads in the dataset. Then, normalization was performed for each PAM using the following equation such that PAM sequences that were under- or over-represented in the initially library were accounted for:

Normalized Frequency=(Treatment Frequency)/
((((Control Frequency)/(Average Control Frequency)))

After normalization, a position frequency matrix (PFM) was calculated. This was done by weighting each nucleotide at each position based on the frequency (normalized) associated with each PAM. For example, if a PAM of 5'-CGGTAGC-3' had a normalized frequency of 0.15%, then the C at first position would be given a frequency of 0.15% when determining the nucleotide frequency for the first PAM position. Next, the overall contribution of each nucleotide at each position in the dataset was summed and organized into a table with the most abundant nucleotides indicating Cas-alpha PAM preferences.

Evidence for Cas-alpha double stranded DNA target cleavage was evaluated by examining the unique junction generated by Cas-alpha target cleavage and adapter ligation. First, a collection of sequences representing all possible outcomes of double stranded DNA cleavage and adapter ligation within the T2 target region were generated (as detailed above). Next, the frequency of the resulting sequences was examined in each Illumina sequence dataset relative to negative controls (experiments setup without Cas-alpha). Protospacer-adapter ligation positions where Illumina sequences were recovered in excess resulting in a peak or spike of read coverage over negative controls were considered as evidence of targeted DNA cleavage.

Example 6: Cas-Alpha Double Stranded DNA Target Recognition and Cleavage

In this Example, the molecular features that impart Cas-alpha double stranded DNA target recognition and cleavage are identified.

Cas-Alpha is a PAM-Dependent dsDNA Endonuclease

Cas-alpha CRISPR (Clustered Regularly Interspaced Short Palindromic Repeats)-Cas (CRISPR associated) endonucleases have been reported to only cleave single stranded DNA targets without the requirement of a protospacer adjacent motif (PAM) (Harrington, L. B. et al. (2018) Science. 10.1126/science.aav4294). In this example, we provide evidence that this novel group of CRISPR-Cas endonucleases, 1) requires a PAM in combination with a 2) guide RNA to 3) recognize and cleave a double stranded DNA target site.

As shown in Table 4, PAM preferences were recovered for Cas-alpha1 when using plasmid R-225 (containing a fully intact Cas-alpha CRISPR-Cas locus modified to target the T2 sequence) providing the first evidence of Cas-alpha double stranded DNA target recognition. PAM preferences only occurred when assuming target DNA cleavage and adapter ligation at a position 21 bp 3' of the PAM region. To confirm double stranded DNA cleavage activity, a plasmid DNA was constructed containing a fixed double stranded DNA target sequence (SEQ ID NO:100) comprised of a non-randomized PAM (5'-TTAT-3') immediately 5' of the T2 target sequence (SEQ ID NO:101). Then using plasmids R-225 and R-654 (see Example 3) and the fixed target sequence, experiments were repeated. As shown in FIGS. 4A-E, these experiments resulted in a spike of sequence reads recovered at the aforementioned position relative to the negative control. For R-654, a T7 IPTG inducible promoter enhanced the fraction of reads recovered (approaching nearly 40% of all reads) immediately after the $21^{st}$ position downstream of the PAM.

(R-658). As shown in FIG. 4E, no DNA cleavage activity was detected. Taken together, this provides the first evidence for Cas-alpha double stranded DNA target cleavage.

Double stranded DNA target recognition and cleavage was examined for a second Cas-alpha protein, Cas-alpha4 (SEQ ID NO:20). Using a solo Cas-alpha4 expression cassette (see Example 2 and FIG. 3), T7 transcribed guide RNA(s) targeting T2, a sequence adjacent to the 7 bp randomized PAM library described in Karvelis et al., 2015, were combined with E. coli lysate containing Cas-alpha4 expressed protein. To determine the orientation of PAM recognition relative to spacer recognition, guide RNA(s) were designed to base pair with either the sense or anti-sense strands of the T2 target (Table 5) (FIG. 5). If the guide RNA(s) designed to base pair with the sense strand result in the recovery of PAM preferences and yield a cleavage signal, then the protospacer is on the anti-sense strand and PAM recognition occurs 3' relative to it (FIG. 5A). Conversely, if the guide RNA(s) designed to base pair with the anti-sense strand produce PAM preferences and a cleavage signal, then the protospacer is on the sense strand and PAM recognition occurs in an orientation 5' to it (FIG. 5B). Upon evaluation of the frequency of adapter ligation at each position in the T2 protospacer target, a peak comprising nearly 30% of all reads was recovered just after the 24th bp 3' of the PAM (FIGS. 6C and 6E). Both guide RNAs producing cleavage signal were designed to target the anti-sense strand of the protospacer, thus, indicating that PAM recognition occurs 5' of the protospacer. Next, PAM recognition was evaluated for Cas-alpha4. As shown in Tables 6 and 7, T-rich PAM preferences similar to Cas-alpha1 were also recovered for Cas-alpha2 when the guide RNAs, T2-2 sgRNA or T2-2 crRNA/tracrRNA, were used.

TABLE 4

Protospacer adjacent motif (PAM) preferences for Cas-alpha1

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 22.95% | 22.92% | 16.12% | 2.74% | 1.83% | 5.71% | 1.59% |
| | T | 24.97% | 35.45% | 37.93% | [90.53%] | [95.44%] | 1.24% | [96.44%] |
| | A | 25.74% | 26.48% | 30.92% | 2.64% | 1.06% | [64.16%] | 1.06% |
| | G | 26.34% | 15.15% | 15.03% | 4.09% | 1.66% | /28.89%/ | 0.91% |
| Consensus | | N | N | N | T | T | A | T |

To confirm that the observed double stranded DNA target recognition and cleavage activity observed was the result of only Cas-alpha1, the tracrRNA encoding region, and the modified CRISPR array, experiments were conducted with plasmid (R-657) containing a minimal Cas-alpha CRISPR-Cas locus (comprised only of the Cas-alpha gene, the region encoding the tracrRNA, and the modified CRISPR array) and the fixed double stranded DNA target sequence. As illustrated in FIG. 4D, a similar cleavage signature was recovered at the $21^{st}$ position 3' of the PAM. Finally, to verify that Cas-alpha was required for the observed cleavage activity, experiments were also conducted when the Cas-alpha gene was removed from the CRISPR-Cas locus

TABLE 5

Cas-alpha4 T7 transcribed guide RNAs

| Name | T2 Strand Targeted | Single Guide RNA SEQID NO | crRNA SEQID NO | tracrRNA SEQID NO |
|---|---|---|---|---|
| T2-1 sgRNA | Sense | 102 | — | — |
| T2-2 sgRNA | Anti-Sense | 103 | — | — |
| T2-1 crRNA/tracrRNA | Sense | — | 104 | 68 |
| T2-2 crRNA/tracrRNA | Anti-Sense | — | 105 | 68 |

TABLE 6

Protospacer adjacent motif (PAM) preferences for Cas-alpha4 when paired with the guide RNA, T2-2 sgRNA Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 27.81% | 21.82% | 19.53% | 3.37% | 2.53% | 5.80% | 0.59% |
| | T | 20.37% | 32.63% | 32.81% | [92.55%] | [97.41%] | [87.54%] | 8.18% |
| | A | 21.98% | 31.52% | 28.51% | 2.65% | 0.01% | 3.05% | [45.46%] |
| | G | 29.85% | 14.02% | 19.14% | 1.43% | 0.06% | 3.61% | [45.77%] |
| Consensus | | N | N | N | T | T | T | R |

TABLE 7

Protospacer adjacent motif (PAM) preferences for Cas-alpha4 when paired with the guide RNA, T2-2 crRNA/tracrRNA Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 28.66% | 20.32% | 18.37% | 2.79% | 1.78% | 4.79% | 0.62% |
| | T | 19.41% | 33.80% | 33.84% | [94.11%] | [97.97%] | [89.27%] | 7.33% |
| | A | 20.56% | 33.10% | 28.94% | 2.14% | 0.01% | 2.83% | [46.66%] |
| | G | 31.36% | 12.78% | 18.85% | 0.95% | 0.24% | 3.12% | [45.39%] |
| Consensus | | N | N | N | T | T | T | R |

To confirm our findings in an entirely biochemical environment, double-stranded DNA target cleavage was reconstituted in vitro. This was accomplished by using purified Cas-alpha4 protein (Example 4) and in vitro T7 transcribed single guide RNA (sgRNA) (SEQ ID NO: 77) (Example 2) to digest double stranded DNA targets. First, to form ribonucleoprotein (RNP) complexes, a 1:1 molar ratio of Cas-alpha4 and sgRNA were incubated in complex assembly buffer (10 mM Tris-HCl, pH 7.5 at 37° C., 100 mM NaCl, 1 mM EDTA, 1 mM DTT) at 37° C. for 30 min. 100 nM of the resulting RNP was then combined with 3 nM of either supercoiled (SC) or linearized plasmid DNA containing a sgRNA target sequence flanked by a Cas-alpha4 PAM (5'-TTTA-3') in reaction buffer (2.5 mM Tris-HCl, pH 7.5 at 37° C., 25 mM NaCl, 0.25 mM DTT and 10 mM MgCl2) and incubated for 30 min. at 37° C. Then, reactions were stopped and analyzed by non-denaturing agarose gel electrophoresis and ethidium bromide staining. As shown in FIG. 15A, SC plasmid DNA was completely converted to a linear form (FLL), thus, illustrating the formation of a dsDNA break. Additionally, cleavage of linear DNA resulted in DNA fragments of an expected size further validating Cas-alpha4 mediated dsDNA break formation (FIG. 15A). Next, by excluding either the PAM or the sgRNA target, we confirmed that Cas-alpha4 absolutely requires a PAM and guide RNA to cleave a dsDNA target (FIG. 15B).

The type of dsDNA break generated by Cas-alpha4 was examined next. Using run-off sequencing, we observed that Cas-alpha4 generates 5' staggered overhanging DNA cut-sites. Cleavage predominantly occurred centered around positions 20-24 bp in respect to PAM-sequence (FIG. 15C).

Next, we investigated if Cas-alpha4 induces non-specific ssDNA degradation activity following dsDNA target recognition. Here, reactions were assembled as described above except 100 nM of dsDNA containing a 5' PAM and adjacent sgRNA target was used as an activator and 100 nM of M13 single-stranded DNA was included to detect Cas-alpha4 induced ssDNase activity. Reactions were also setup without the sgRNA to illustrate that dsDNA targeting is a prerequisite of indiscriminate ssDNA cleavage. As shown in FIG. 15D, trans-acting ssDNase activity of Cas-alpha4 was activated by dsDNA only in the presence of a guide RNA To investigate the broad applicability of our findings, Cas-alphas 2 (SEQ ID NO:18), 3 (SEQ ID NO:19), 5 (SEQ ID NO:32), 6 (SEQ ID NO:33), 7 (SEQ ID NO:34), 8 (SEQ ID NO:35), 9 (SEQ ID NO:36), 10 (SEQ ID NO:37), and 11 (SEQ ID NO:38) were also evaluated for double stranded DNA target recognition and cleavage. Using a minimal CRISPR-Cas locus (comprising the cas-alpha endonuclease gene, the region encoding the tracrRNA, and the T2 modified CRISPR array (FIG. 3)) synthesized into a bacterial T7 expression cassette (pETduet-1 (MilliporeSigma)), E. coli lysate experiments were performed as described in Example 4 with and without IPTG induction. As shown in FIGS. 16A-16T, double stranded DNA target cleavage was detected for all except Cas-alpha 5. In general, and similar to results with Cas-alpha 1 and 4, protospacer positions 21 and 24 3' of the region of PAM randomization exhibited the highest frequency of adapter-ligated reads. Similar to Cas-alpha 1 and 4, 5' PAM recognition was also recovered (Tables 8-15).

Taken together, the data described herein provides evidence that Cas-alpha proteins are directed by guide RNA(s) to recognize and cleave double stranded DNA target sites in the presence of a 5' PAM.

TABLE 8

Protospacer adjacent motif (PAM) preferences for Cas-alpha2

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 27.16% | 27.49% | 24.86% | 18.78% | 1.04% | 0.94% | 1.59% |
| | T | 23.45% | 27.16% | 30.20% | /46.93%/ | [98.67%] | [99.03%] | 0.91% |
| | A | 23.83% | 27.04% | 22.36% | 13.40% | 0.20% | 0.00% | [44.59%] |
| | G | 25.56% | 18.31% | 22.58% | 20.89% | 0.09% | 0.03% | [52.91%] |
| Consensus | | N | N | N | N (T > V) | T | T | R |

TABLE 9

Protospacer adjacent motif (PAM) preferences for Cas-alpha3

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 24.20% | 22.03% | 12.82% | 3.44% | 0.03% | 2.29% | 0.49% |
| | T | 24.96% | 28.54% | /41.83%/ | [81.31%] | [99.83%] | [97.50%] | 1.67% |
| | A | 28.67% | 34.66% | 34.60% | 7.52% | 0.01% | 0.02% | [42.66%] |
| | G | 22.17% | 14.76% | 10.75% | 7.72% | 0.13% | 0.19% | [55.18%] |
| Consensus | | N | N | N (W > S) | T | T | T | R |

TABLE 10

Protospacer adjacent motif (PAM) preferences for Cas-alpha6

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 25.57% | 23.71% | 20.38% | 6.56% | 0.09% | 0.75% | 1.72% |
| | T | 20.76% | 24.38% | 33.64% | [88.29%] | [99.70%] | [98.29%] | 0.50% |
| | A | 25.73% | 30.31% | 31.04% | 3.36% | 0.04% | 0.90% | [55.68%] |
| | G | 27.94% | 21.60% | 14.94% | 1.79% | 0.18% | 0.06% | [42.10%] |
| Consensus | | N | N | N | T | T | T | R |

TABLE 11

Protospacer adjacent motif (PAM) preferences for Cas-alpha7

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 23.92% | 14.67% | 30.89% | 35.82% | 4.62% | 3.77% | 6.56% |
| | T | 27.66% | 35.68% | /40.15%/ | /45.01%/ | [94.62%] | [92.32%] | 11.97% |
| | A | 23.41% | 38.99% | 17.44% | 13.91% | 0.54% | 2.48% | /53.85%/ |
| | G | 25.00% | 10.66% | 11.53% | 5.26% | 0.22% | 1.43% | 27.62% |
| Consensus | | N | N | N (Y > R) | N (Y > R) | T | T | N (A > G > Y) |

TABLE 12

Protospacer adjacent motif (PAM) preferences for Cas-alpha8

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 23.87% | 15.70% | 32.93% | 33.72% | 0.09% | 0.31% | 2.09% |
| | T | 34.05% | /47.29%/ | /40.50%/ | [59.74%] | [99.80%] | [99.48%] | 6.62% |
| | A | 17.43% | 30.27% | 14.82% | 6.06% | 0.00% | 0.00% | [46.71%] |
| | G | 24.65% | 6.74% | 11.76% | 0.48% | 0.11% | 0.20% | [44.58%] |
| Consensus | | N | N (W > S) | N (Y > R) | T | T | T | R |

TABLE 13

Protospacer adjacent motif (PAM) preferences for Cas-alpha9

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 27.75% | 24.68% | 21.31% | 27.66% | [94.23%] | 0.61% | 12.51% |
| | T | 25.91% | 27.08% | 28.18% | 25.92% | 4.72% | [97.50%] | [87.48%] |
| | A | 18.82% | 29.30% | 28.38% | 23.24% | 0.86% | 0.18% | 0.00% |
| | G | 27.52% | 18.95% | 22.12% | 23.17% | 0.18% | 1.72% | 0.00% |
| Consensus | | N | N | N | N | C | T | T |

TABLE 14

Protospacer adjacent motif (PAM) preferences for Cas-alpha10

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 28.95% | 22.41% | 29.44% | 11.54% | 5.78% | 4.62% | [74.42%] |
| | T | 26.49% | 27.58% | 20.35% | 23.90% | [84.34%] | [93.40%] | 20.79% |
| | A | 16.96% | 34.00% | 22.28% | 20.71% | 6.54% | 0.97% | 3.16% |
| | G | 27.60% | 16.01% | 27.93% | /43.85%/ | 3.35% | 1.01% | 1.64% |
| Consensus | | N | N | N | N (T > W > C) | T | T | C |

TABLE 15

Protospacer adjacent motif (PAM) preferences for Cas-alpha11

Displayed as a position frequency matrix (PFM). PAM positions are numbered backward from the first position of the protospacer target with position −1 being immediately 5' of the first position of the T2 protospacer target. Numbers in brackets [x] represent strong PAM preferences, numbers in slashes /x/ represent weak PAM preferences.

| | | PAM Position | | | | | | |
|---|---|---|---|---|---|---|---|---|
| | | −7 | −6 | −5 | −4 | −3 | −2 | −1 |
| Nucleotide | C | 24.79% | 23.95% | 27.18% | 26.09% | [100.00%] | [99.92%] | 1.66% |
| | T | 27.18% | 26.39% | 25.05% | 25.23% | 0.00% | 0.01% | [29.92%] |
| | A | 23.12% | 24.69% | 23.35% | 25.36% | 0.00% | 0.07% | [33.27%] |
| | G | 24.91% | 24.97% | 24.42% | 23.33% | 0.00% | 0.00% | [35.15%] |
| Consensus | | N | N | N | N | C | C | D |

Determination of Optimal Conditions for Cas-Alpha Cleavage

Biochemical experiments to determine parameters and conditions for optimal RNA-guided Cas-alpha endonuclease cleavage of dsDNA were conducted using methods known in the art. Briefly, purified Cas-alpha protein and T7 transcribed guide RNA were incubated in Complex Assembly (CA) buffer (10 mM Tris-HCl, pH 7.5 at 37° C., 100 mM NaCl and 1 mM DTT). The resulting RNP complexes were then combined with double stranded plasmid DNA containing a 5' PAM immediately adjacent to a region with complementarity to the guide RNA (for example, as illustrated in FIG. 5B). Cleavage reactions were then performed in Reaction (R) buffer (10 mM Tris-HCl, pH 7.5 at 37° C., 100 mM NaCl and 1 mM DTT, 10 mM MgCl2) under various conditions. For experiments assaying the metal co-factor, the magnesium in buffer R was replaced with either cobalt ($Co^{2+}$), manganese ($Mn^{2+}$), or nickel ($Ni^{2+}$). Supercoiled double-stranded plasmid DNA cleavage was assessed by examining the ratio of supercoiled (SC), nicked open circle (OC), and full length linearized (FLL) products. For linear double-stranded plasmid DNA substrates, the fraction of un-cleaved products relative to the smaller cleaved products was used to calculate cleavage efficiency.

Example 7: Optimization of Cas-Alpha Components for Eukaryotic Genome Editing and Manipulation In this Example, methods to optimize Cas-alpha endonuclease and guide RNA expression cassettes or purified components for delivery into eukaryotic cells are described.

In one method, to confer efficient expression in eukaryotic cells, the novel Cas endonuclease gene, cas-alpha, was codon optimized per standard techniques known in the art and optionally an intron was introduced in order to eliminate its expression in *E. coli* or *Agrobacterium* (used for plant transformation). For use in *Zea mays*, the potato ST-LS1 intron 2 (SEQ ID NO: 106) was used although other introns would work. To facilitate nuclear localization of the optimized Cas-alpha endonuclease protein in eukaryotic cells, a nucleotide sequence encoding the Simian virus 40 (SV40) monopartite nuclear localization signal (NLS) (SEQ ID NO: 107) may be added to either the 5', 3', or both 5' and 3' ends. Other NLSs can also be used. For example, in human cell culture experiments, a sequence encoding the bi-partite NLS from nucleoplasmin (Nuc) (SEQ ID NO: 108) was optionally appended to the 3' end of the human codon optimized gene. The nucleotide sequences of the different maize optimized Cas-alpha endonuclease gene and nuclear localization signal variants, were then operably linked to a promoter (ubiquitin (UBI) promoter (SEQ ID NO: 109) for maize expression constructs and chicken β-actin promoter (SEQ ID NO: 110) for human cell culture expression constructs) and optionally an enhancer (for example the cytomegalovirus (CMV) enhancer (SEQ ID NO: 111) for human cell genome editing) and suitable terminator by standard molecular biological techniques. To further enhance expression, a 5' untranslated region (UTR) (for example but not limited to the maize UBI 5' UTR (SEQ ID NO: 112) for *Zea mays* genome editing) and additional introns (for example the UBI *Zea mays* intron 1 (SEQ ID NO: 113) for maize genome editing and a synthetic "hybrid" intron (SEQ ID NO: 114) for human cell genome editing) can be included. Additionally, reduced (for example but not limited to a ROX3 promoter (SEQ ID NO:136) for *Saccharomyces cerevisiae* genome editing) or controlled (for example but not limited to a GAL promoter (SEQ ID NO:137) for *Saccharomyces cerevisiae* genome editing) expression might be desirable. Examples of the eukaryotic cell optimized DNA expression constructs are illustrated in FIG. 10A-D.

The Cas-alpha endonuclease is directed by small RNAs (referred to herein as guide RNAs) to cleave double-stranded DNA. These guide RNAs comprise a sequence that aids recognition by Cas-alpha (referred to as Cas-alpha recognition domain) and a sequence that serves to direct Cas-alpha cleavage by base pairing with one strand of the DNA target site (Cas-alpha variable targeting domain). To transcribe small RNAs necessary for directing Cas-alpha endonuclease cleavage activity in maize cells, a U6 polymerase III promoter (SEQ ID NO: 115) and terminator (TTTTTTTT) are isolated from maize and operably fused to the ends of DNA sequences that upon transcription would result in a suitable guide RNA for Cas-alpha. Alternatively, for HEK293 cells, a U6 promoter from the human genome (SEQ ID NO: 116) is isolated and used to drive guide RNA expression and a linear fragment containing without a U6 terminator is utilized. To promote optimal transcription of the guide RNA from the U6 polymerase III promoters a G nucleotide is added to the 5' end of the sequence to be transcribed. Polymerase II promoters (for example but not limited to those listed for Cas-alpha endonuclease expression) in combination with a ribozyme motif (Gao, Y. et al. (2014) *J Integr Plant Biol.* 56:343-349)), RNase P and Z cleavage sites (Xie, K. et al. (2015) *Proc. Natl. Acad. Sci. USA.* 112:3570-3575), and/or Csy4 (Cas6 or CasE) ribonuclease recognition site (Tsai, S. Q. et al. (2014) *Nat Biotechnol.* 32:569-576.) can also be used to express the guide RNA. Moreover, the RNA processing provided by these strategies can also be harnessed to express multiple guide RNAs from either a single polymerase II or III promoter (Gao, Y. et al. (2014), Xie, K. et al. (2015), and Tsai, S. Q. et al. (2014)). Examples of the eukaryotic optimized Cas-alpha guide RNA expression constructs are illustrated in FIG. 11A-D.

In another method, Cas-alpha endonuclease and guide RNA ribonucleoprotein (RNP) complexes were prepared and delivered directly into the eukaryotic cell. To accomplish this, Cas-alpha genes, either native or *E. coli* codon optimized, were appended with sequences encoding a 6× histidine (His) (SEQ ID NO: 82) or streptavidin (strep II) (SEQ ID NO: 117) tag, a maltose binding protein (MBP) tag (SEQ ID NO: 83), a tobacco etch virus cleavage site (TEV) (SEQ ID NO:84), and a NLS (either SEQ ID NO: 107 and 108) included either at the N- or C-terminal or both N- and C-terminal ends of the cas-alpha gene (FIG. 12). Next, the resulting sequences were synthesized (GenScript) into an arabinose inducible *E. coli* expression cassette (pBAD24). Example of the resulting engineered genes are shown in FIG. 12. Then, Cas-alpha protein was recombinantly expressed in *E. coli* (for example but not limited to Arctic-Express (DE3) (ThermoFisher Scientific) and purified by chromatography using methods known in the art. The tags (His, strep II, and MBP) were optionally removed using the TEV protease (ThermoFisher Scientific).

Next, Cas-alpha guide RNAs were synthesized in vitro using T7 polymerase. Linear DNA (synthesized as overlapping oligos (IDT) and then converted into double stranded DNA by PCR or synthesized (GenScript) and then amplified by PCR) encoding the sgRNA was used as template.

Finally, RNP complexes were prepared by incubating purified Cas-alpha protein with the guide RNA in complex assembly (CA) buffer (10 mM Tris-HCl, pH 7.5 at 37° C., 100 mM NaCl and 1 mM DTT) and delivered into the eukaryotic cell.

Example 8: Transformation of Optimized Cas-Alpha System Components for Eukaryotic Genome Editing and Manipulation In this example, methods for introducing a novel Class 2 endonuclease (Cas-alpha) and associated guide polynucleotide(s) into eukaryotic cells for genome editing and manipulation are described.

*Zea mays* Transformation
Particle-Mediated Delivery of DNA Expression Cassettes Particle gun transformation of Hi-Type II 8 to 10-day-old immature maize embryos (IMEs) in the presence of BBM and WUS2 genes was carried-out as described in Svitashev et al. (2015) *Plant Physiology.* 169:931-945. Briefly, DNA expression cassettes were co-precipitated onto 0.6 μM (average size) gold particles utilizing TransIT-2020. Next, the DNA coated gold particles were pelleted by centrifugation, washed with absolute ethanol and re-dispersed by sonication. Following sonication, 10 μl of the DNA coated gold particles were loaded onto a macrocarrier and air dried. Next, biolistic transformation was performed using a PDS-1000/He Gun (Bio-Rad) with a 425 pound per square inch rupture disc. Since particle gun transformation can be highly variable, a visual marker DNA expression cassette encoding a yellow fluorescent protein (YFP) was also co-delivered to aid in the selection of evenly transformed IMEs and each treatment was performed in triplicate. To determine the plant transformation culture conditions optimal for Cas-alpha binding or mutational activity, transformed IMEs is incubated at 28° C. for 48 hours, or at a range of temperatures lower or higher than 28° C. to establish the temperature optimum for Cas-alpha genome editing.

Particle-Mediated Ribonucleoprotein Delivery

Cas-alpha and associated guide polynucleotide(s) ribonucleoprotein (RNP) complex(es) can be delivered by particle gun transformation as described in Svitashev, S. et al. (2016) *Nat. Commun.* 7:13274. Briefly, RNPs (and optionally DNA expression) are precipitated onto 0.6 mm (average diameter) gold particles (Bio-Rad) using a water soluble cationic lipid TransIT-2020 (Minis) as follows: 50 ml of gold particles (water suspension of 10 mg/ml) and 2 ml of TransIT-2020 water solution are added to the premixed RNPs (and optionally DNA expression vectors), mixed gently, and incubated on ice for 10 min. RNP/DNA-coated gold particles are then pelleted in a microfuge at 8,000 g for 30 s and supernatant is removed. The pellet is then resuspended in 50 ml of sterile water by brief sonication. Immediately after sonication, coated gold particles are loaded onto a microcarrier (10 ml each) and allowed to air dry. Immature maize embryos, 8-10 days after pollination, are then bombarded using a PDS-1000/He Gun (Bio-Rad) with a rupture pressure of 425 pounds per inch square. Post-bombardment culture, selection, and plant regeneration are performed using methods known in the art.

*Agrobacterium*-Mediated Transformation

*Agrobacterium*-mediated transformation is performed essentially as described in Djukanovic et al. (2006) Plant Biotech J 4:345-57. Briefly, 10-12 day old immature embryos (0.8-2.5 mm in size) are dissected from sterilized kernels and placed into liquid medium (4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 68.5 g/L sucrose, 36.0 g/L glucose, pH 5.2). After embryo collection, the medium is replaced with 1 ml *Agrobacterium* at a concentration of 0.35-0.45 OD550. Maize embryos are incubated with *Agrobacterium* for 5 min at room temperature, then the mixture is poured onto a media plate containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 30.0 g/L sucrose, 0.85 mg/L silver nitrate, 0.1 nM acetosyringone, and 3.0 g/L Gelrite, pH 5.8. Embryos are incubated axis down, in the dark for 3 days at 20° C., then incubated 4 days in the dark at 28° C. at which time they may be harvested for DNA extraction.

In another variation for stable transformation, the embryos are then transferred onto new media plates containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.69 g/L L-proline, 30.0 g/L sucrose, 0.5 g/L MES buffer, 0.85 mg/L silver nitrate, 3.0 mg/L Bialaphos, 100 mg/L carbenicillin, and 6.0 g/L agar, pH 5.8. Embryos are subcultured every three weeks until transgenic events are identified. Somatic embryogenesis is induced by transferring a small amount of tissue onto regeneration medium (4.3 g/L MS salts (Gibco 11117), 5.0 ml/L MS Vitamins Stock Solution, 100 mg/L myo-inositol, 0.1 uM ABA, 1 mg/L IAA, 0.5 mg/L zeatin, 60.0 g/L sucrose, 1.5 mg/L Bialaphos, 100 mg/L carbenicillin, 3.0 g/L Gelrite, pH 5.6) and incubation in the dark for two weeks at 28° C. All material with visible shoots and roots are transferred onto media containing 4.3 g/L MS salts (Gibco 11117), 5.0 ml/L MS Vitamins Stock Solution, 100 mg/L myo-inositol, 40.0 g/L sucrose, 1.5 g/L Gelrite, pH 5.6, and incubated under artificial light at 28° C. One week later, plantlets are moved into glass tubes containing the same medium and grown until they were sampled and/or transplanted into soil.

HEK293 Transformation

Cell Culture Lipofection

HEK293 (ATCC) cells were cultured in DMEM (Gibco) with 10% FBS (Gibco) and penicillin/streptomycin (Gibco) at 37° C. in 5% $CO_2$. A day prior to transfection cells were seeded in 96-well plates at $3.6 \times 10^4$ density. NLS-tagged Cas-alpha RNP complex was assembled by mixing 20 pmol of purified protein with 20 pmol of sgRNA in 25 µl Opti-MEM (Gibco) and incubated at room temperature for 30 min. After complex assembly 25 µl of Opti-MEM, containing 1.2 µl Lipofectamine 3000 (Thermo Fisher Scientific) was added and the mixture was incubated for additional 15 min at room temperature before transfection of the cells. Genomic DNA was extracted 72 h after transfection using QuickExtract DNA Extraction Solution (Lucigen) and regions surrounding target sites evaluate for the presence of mutations indicative of DNA double strand break and repair.

Cell Culture Electroporation

Cas9 RNPs were electroporated into HEK293 (ATCC Cat #CRL-1573) cells using the Lonza 4D-Nucleofector System and the SF Cell Line 4D-Nucleofector® X Kit (Lonza). For each electroporation, RNPs were formed by incubating 100 pmoles of sgRNA with 50 pmoles of Cas9 protein in nucleofector solution in a volume of 17 µL at room temperature for 20 minutes. HEK293 cells were released from culture vessels using TrypLE™ Express Enzyme 1× (ThermoFisher) washed with 1×PBS without Ca++ or Mg++ (ThermoFisher) and counted using a LUNA™ Automated Cell Counter (Logos Biosystems). For each electroporation, $1 \times 10^5$ live cells were resuspended in 9 µL electroporation solution. Cells and RNP were mixed and transferred to one well of a 16-well strip and electroporated using the CM-130 program. 754, of pre-warmed culture was added to each well and 10 µL of the resultant resuspended cells were dispensed into a well of a 96-well culture vessel containing 125 µL of pre-warmed culture medium. Electroporated cells were incubated at 37° C., 5% CO2 in a humidified incubator for 48-96 hours before analysis of genome editing.

*Saccharomyces cerevisiae* Transformation

Several methods (lithium acetate, polyethylene glycol (PEG), heat shock, electroporation, biolistic, and others) can be used to transform *S. cerevisiae* (Kawai, S. et al. (2010) Bioengineered Bugs. 1:395-403). Here we used an approach similar to a lithium cation-based method using the Frozen-EZ yeast Transformation II kit (Zymo Research, T2001). Per the manufacture's instruction, *S. cerevisiae* competent cells were produced. This was accomplished by growing *S. cerevisiae* (BY4742 (Baker, C. et al. (1998) Yeast. 14:115-132) (ATCC)) in yeast extract-peptone-dextrose (YPD) (Gibco) to mid-log phase corresponding to an OD 600 nm of 0.8-1.0. Next, the cells were pelleted by centrifugation (500×g for 4 minutes), media decanted, and the pellet gently washed with 10 ml of EZ 1 solution spinning down the cells again prior to removing the wash solution. Next, the cells were resuspended in 1 ml of EZ 2 solution. The resulting competent cells were then aliquoted and either stored at −70° C. or used in the next step. Transformation was performed next by adding 0.5-1 µg (in less than 5 µl) of Cas-alpha and guide RNA DNA expression cassettes to 50 ul of competent cells. Optionally, double stranded DNA repair template with homology flanking the expected Cas-alpha double strand break site was also included (0.5 ul at 50 µM). After gently mixing in the DNA, 500 µl of EZ 3 solution was added. Next, cells were incubated at 30° C. for 60-90 min. flicking or vortexing the cells 3-4 times over the duration of the incubation. After transformation, cells were grown-out in YPD for ~3 hrs, pelleted, washed once with 1 ml of sterile water, resuspended in 1 ml of sterile water, and then ~200 µl plated onto selective media (for example but not limited to Synthetic medium minus histidine (SC-HIS)).

Example 9: Functional Formation of an Optimized Cas-Alpha/Guide Polynucleotide Complex in Eukaryotic Cells In this example, a method for examining the functional formation of a novel Class 2 endonuclease (Cas-alpha) and associated guided RNA(s) (polynucleotide(s)) complex in eukaryotic cells are described.

The functional formation of a novel Class 2 endonuclease (Cas-alpha) and guide RNA(s) complex in eukaryotic cells was monitored by examining one or more different chromosomal DNA target sequences for the presence of insertion and deletion (indel) mutations indicative of DNA target site double stranded cleavage and cellular repair. This was carried-out by targeted deep sequencing as described in described in Karvelis, T. et al. (2015) *Genome Biology.* 16:253 (Methods Section: in planta mutation detection) or other equivalent methods devised to detect alterations in DNA. Briefly, for *Zea mays*, the 20-30 most evenly transformed immature embryos (IEs), based on their fluorescence, were harvested two days after transformation for each experiment. Next, total genomic DNA was extracted and the region surrounding the intended target site was PCR amplified with Phusion® HighFidelity PCR Master Mix (New England Biolabs, M0531L) adding on the sequences necessary for amplicon-specific barcodes and Illumina sequencing using "tailed" primers through two rounds of PCR and deep sequenced. The resulting reads were then examined for the presence of mutations at the expected site of cleavage by comparison to control experiments where the small RNA transcriptional cassette was omitted from the transformation. Sequence reads containing putative indels where further validated as true mutations by confirming their absence in the control datasets.

For *Saccharomyces cerevisiae*, a similar approach was applied except colonies exhibiting a red cellular phenotype resulting from the disruption of the ade2 gene (Ugolini et al. (1996) Curr. Genet. 30:485-492) were selected prior to DNA extraction, PCR amplification, and Illumina deep sequencing.

For HEK293, a similar process was performed except the cell culture was harvested 72 hours after transformation.

As illustrated in FIG. 13 and shown in Table 16, particle gun experiments delivering Cas-alpha DNA expression constructs into *Zea mays* IEs yielded predominantly deletion mutations at and encompassing the chromosomal DNA target sites for the Cas-alpha4 and guide RNA complex. In these experiments, a maize codon optimized cas-alpha4 gene (SEQ ID NO: 235) configured for expression as shown in FIG. 10B (except to sequence encoding the SV40 NLS was added in-frame at the 3' end of the gene) was used. sgRNAs (Table 19) with a 20 nt region capable of base pairing with a chromosomal DNA target sequence immediately adjacent to a suitable PAM for Cas-alpha4 (5'-TTTR-3', where R represents either A or G residues; see Table 7) were expressed from a *Zea mays* U6 promoter as illustrated in FIG. 11B. In this instance, two guide RNAs were used to direct Cas-alpha4 cleavage at two target sites in the *Zea mays* Liguleless locus.

TABLE 16

Cas-alpha endonucleases generate targeted double
strand breaks in plant cell genomic DNA
Mutations were found at plant cell genomic target sites as a result
of Cas-alpha4 endonuclease target DNA cleavage and double strand
break repair. All mutations displayed positive read counts, and none
were found in the negative control samples.

| Sequence reads recovered | SEQ ID NO: | Found in Negative Control? | Read Count |
|---|---|---|---|
| WT Reference | 120 | Yes | 583996 |
| Negative Control | — | — | 0 |
| Mutation 1 | 121 | No | 4 |
| Mutation 2 | 122 | No | 2 |
| Mutation 3 | 123 | No | 2 |
| Mutation 4 | 124 | No | 2 |

Furthermore, as illustrated in FIGS. 18A and B and shown in Table 17, particle gun experiments delivering Cas-alpha10 DNA expression constructs into *Zea mays* IEs resulted in the recovery of targeted deletions. In these experiments, a maize codon optimized cas-alpha10 gene (SEQ ID NO: 236) configured for expression as shown in FIG. 10B was used (except a sequence encoding the SV40 NLS was added in-frame at the 3' end of the gene). sgRNAs (Table 19) with a 20 nt region capable of base pairing with a chromosomal DNA target sequence immediately adjacent to a suitable PAM for Cas-alpha10 were expressed from a *Zea mays* U6 promoter as illustrated in FIG. 11B. A transgenic construct driving expression of a plant selectable marker, neomycin phosphotransferase (nptII), stably inserted into the maize genome was targeted for cleavage with Cas-alpha10 (5'-TTC-3'; Table 16). As shown in FIG. 18A and Table 17, deletions not found in the controls (experiments setup omitting the sgRNA expression cassette) were recovered that originated within or spanned the expected site of cleavage. To confirm our findings, a single non-transgenic chromosomal DNA target within the fifth exon of the ms26 gene (Chr1:14,702,638-14,702,654 (Maize B73 RefGen_4 (Jiao, Y. et al. (2017) Nature. 546: 524-527)) was also targeted for cleavage (using sgRNA 10.25.ms26 in Table 19). Like the nptII target, this site also produced targeted deletions at or near the nuclease cut site (FIG. 18A, 18B and Table 17).

TABLE 17

Cas-alpha10 generates targeted double strand
breaks in plant cell genomic DNA
Mutations were found at plant cell genomic target sites as a result
of Cas-alpha10 endonuclease target DNA cleavage and double strand
break repair. All mutations displayed positive read counts, and none
were found in the negative control samples.

| Zea mays target site | Sequence reads recovered | SEQ ID NO: | Found in Negative Controls? | Read Count |
|---|---|---|---|---|
| nptII | WT Reference | 144 | Yes | 155252 |
|  | Negative Control | — | — | 0 |
|  | Mutation 1 | 145 | No | 15 |
|  | Mutation 2 | 146 | No | 13 |
|  | Mutation 3 | 147 | No | 11 |
|  | Mutation 4 | 148 | No | 10 |
|  | Mutation 5 | 149 | No | 10 |
|  | Mutation 6 | 150 | No | 8 |
|  | Mutation 7 | 151 | No | 8 |
|  | Mutation 8 | 152 | No | 8 |
|  | Mutation 9 | 153 | No | 8 |
|  | Mutation 10 | 154 | No | 8 |
|  | Mutation 11 | 155 | No | 6 |
|  | Mutation 12 | 156 | No | 5 |
|  | Mutation 13 | 157 | No | 5 |
|  | Mutation 14 | 158 | No | 5 |
|  | Mutation 15 | 159 | No | 5 |
|  | Mutation 16 | 160 | No | 4 |
|  | Mutation 17 | 161 | No | 2 |
|  | Mutation 18 | 162 | No | 2 |
|  | Mutation 19 | 163 | No | 2 |
| ms26 | WT Reference | 164 | Yes | 581646 |
|  | Negative Control | — | — | 0 |
|  | Mutation 1 | 165 | No | 57 |
|  | Mutation 2 | 166 | No | 26 |
|  | Mutation 3 | 167 | No | 24 |
|  | Mutation 4 | 168 | No | 13 |
|  | Mutation 5 | 169 | No | 5 |

Target DNA cleavage and repair was also observed in *Saccharomyces cerevisiae* (FIGS. 19A-C). Here, an exogenously supplied DNA repair template (double stranded) with homology flanking a Cas-alpha10 target site was used to introduce one or two premature stop codons (depending on the DNA repair outcome) in the ade2 gene following a Cas-alpha10 induced double strand break (DSB) (FIG. 19A). Additionally, to avoid targeting of the repair template, it also contained a T to A change in the PAM region for Cas-alpha10. As shown, in FIG. 19B, a red cellular phenotype indicative of ade2 gene disruption was recovered when both the repair template and Cas-alpha10 and sgRNA expression constructs were transformed. The Cas-alpha10 expression construct was configured as shown in FIG. 10C using a yeast codon optimized gene (SEQ ID NO: 137). The ade2 targeting sgRNA (Table 19) was expressed from a SNR52 promoter using flanking HH and HDV ribozymes (FIG. 11C). Sequencing of the Cas-alpha10 ade2 gene target site confirmed the introduction of at least one stop codon in 3 independent red colonies (FIG. 19C). Additionally, only the changes in the repair template closest to the Cas-alpha10 site of cleavage were incorporated providing further evidence for the repair of a Cas-alpha10 induced DSB (FIG. 19C). Moreover, this repair outcome suggests that only one or two mismatches towards the distal end of the guide RNA target was enough to abolish cleavage activity (since no other mutations were recovered), altogether, indicating that Cas-alpha nucleases provide excellent guide RNA-DNA target recognition specificity. To confirm that Cas-alpha10 was absolutely required for the outcome, control experiments delivering the DNA repair template alone were assembled. They produced only white colonies, further validating the ability of Cas-alpha10 (and guide RNA) to recognize and cleave a chromosomal DNA target site as measured here by homology-directed repair.

DNA cleavage and repair of HEK293 chromosomal targets also resulted in deletion mutations (FIGS. 14A and B and Table 18). Transformation experiments performed both with DNA expression cassettes (see FIGS. 10A and 11A) and directly with eukaryotic engineered Cas-alpha4 sgRNA ribonucleoprotein (RNP) complexes yielded mutations. In all, mutations were recovered from two HEK293 genomic targets, VEGFA2 and 3 (FIGS. 14A and B).

TABLE 18

Cas-alpha endonucleases generates targeted double strand breaks in animal cell genomic DNA
Mutations were found at animal cell genomic target sites as a result of Cas-alpha endonuclease target DNA cleavage and double strand break repair. All mutations displayed positive read counts, and none were found in the negative control samples.

| Delivery | | Found in Controls? | Read Count |
|---|---|---|---|
| Ribonucleo- | | VEGFA 2 | |
| protein | Wt Reference | | 385293 |
| (RNP) | Negative Control | | 0 |
| | Mutation 1 | No | 442 |
| | | VEGFA 2 | |
| | Wt Reference | | 260251 |
| | Negative Control | | 0 |
| | Mutation 1 | No | 54 |
| | | VEGFA 2 | |
| | Wt Reference | | 265110 |
| | Negative Control | | 0 |
| | Mutation 1 | No | 186 |
| | Mutation 2 | No | 95 |
| | Mutation 3 | No | 84 |
| | | VEGFA 3 | |
| | Wt Reference | | 942942 |
| | Negative Control | | 0 |
| | Mutation 1 | No | 164 |
| DNA | | VEGFA 3 | |
| Expression | Wt Reference | | 160628 |
| Cassette | Negative Control | | 0 |
| | Mutation 1 | No | 58 |
| | | VEGFA 3 | |
| | Wt Reference | | 212590 |
| | Negative Control | | 0 |
| | Mutation 1 | No | 45 |

TABLE 19

Cas-alpha single guide RNAs producing targeted mutagenesis in *Zea mays*, *Saccharomyces cerevisiae*, and *Homo sapiens* (HEK293) cells

| Cas-alpha | Name | sgRNA "Backbone" (SEQ ID NO.) | sgRNA Target Sequence (SEQ ID NO.) | Complete sgRNA ("backbone" + Target Sequence) (SEQ ID NO.) |
|---|---|---|---|---|
| 4 | Liguleless 2 | 238 | 240 | 247 |
| 4 | Liguleless 3 | 238 | 241 | 248 |
| 10 | nptII | 239 | 242 | 249 |
| 10 | ms26 | 239 | 243 | 250 |
| 10 | ade2 | 239 | 244 | 251 |
| 4 | VEGFA2 | 238 | 245 | 252 |
| 4 | VEGFA3 | 238 | 246 | 253 |

Mutations due to Cas-alpha double strand break cleavage and repair at a genomic DNA target site were recovered in plant, yeast, and animal cells, with examples of using recombinant DNA constructs as well as ribonucleoprotein delivery. These data present the first evidence of Cas-alpha guide polynucleotide complex formation and cleavage activity in eukaryotic cells, plant (*Zea mays*), yeast (*Saccharomyces cerevisiae*), and animal (*Homo sapiens*) cells.

Example 10: Double Strand DNA Cleavage in Prokaryotic Cell Assays

In this example, a method for examining the functional formation of a novel Class 2 endonuclease (Cas-alpha) and associated guided RNA(s) (polynucleotide(s)) complex in heterologous prokaryotic cells are described.

As shown in FIG. 17A, one method to assess Cas-alpha double stranded DNA target cleavage is to examine its ability to interfere with plasmid DNA transformation in *E. coli* cells (Burstein, D. et al. (2017) Nature. 542:237-241). Here, a double stranded plasmid DNA comprising a selectable marker (for example but not limited to Ampicillin) and a Cas-alpha target site (a region capable of base pairing with the CRISPR RNA that is in the vicinity of a protospacer adjacent motif (PAM)) is transformed into *E. coli* (Arctic-Express DE3 or equivalent) that contains a Cas-alpha endonuclease and guide RNA expression cassette, by methods known in the art (for example but not limited to electroporation). In the absence of double stranded DNA target cleavage, many cells containing the plasmid and antibiotic resistance marker are recovered by growth on selective media. In contrast, double stranded DNA target cleavage of the in-coming plasmid DNA results in a reduction or interference in the recovery of resistant cells.

To assess the dsDNA cleavage activity of Cas-alpha2, 3, 6, 7, 8, 9, 10, and 11, plasmid DNA interference experiments were assembled in *E. coli* cells. Experiments setup with plasmids that didn't contain a Cas-alpha target site, "no target", provided a baseline for transformation efficiency. Also, interference experiments were performed with and without IPTG (0.5 mM) to examine target cleavage under different Cas-alpha endonuclease and guide RNA expression conditions. 100 ng of either "target" or "no target" plasmid DNA was transformed into Arctic Express (DE3) cell lines containing IPTG inducible Cas-alpha endonuclease and guide RNA expression cassettes (e.g. R-657). Transformations were diluted in 10-fold increments, spotted on selective media, grown overnight at 37° C., and inspected for bacterial colony growth.

FIGS. 17B-17E show the results for Cas-alphas 2, 3, 6, 7, 8, 9, 10, and 11. Cas-alpha3 and 11 (FIGS. 17B and E) were cytotoxic upon induction of expression as evident by a reduced recovery of transformants in both "no target" and "target" experiments and Cas-alpha2 and 6 failed to exhibit any impact on plasmid transformation (FIGS. 17B and C). This can be contrasted with Cas-alpha7 and 9 that provided weak interference activity (FIGS. 17C and D) and Cas-alpha8 and 10 that robustly decreased the number of "target" transformed colonies FIGS. 17D and E.

Taken together, this illustrates that some but not all Cas-alpha endonucleases and guide RNAs function to recognize and cleave dsDNA targets in a heterologous prokaryotic cellular environment.

Example 11: Cas-Alpha Phylogenetic Analysis

In this Example, methods for evaluating the phylogenetic relationship of a novel group of class 2 CRISPR (Clustered Regularly Interspaced Short Palindromic Repeat)-Cas (CRISPR associated) endonucleases, Cas-alpha, are described.

To identify distant relatives, two iterations of PSI-BLAST were performed with Cas-alpha 1-11 selecting only those alignments containing at least 70% full-length coverage for the construction of position-specific scoring matrices (PSSMs) between rounds of PSI-BLAST. Next, only those proteins that were encoded adjacent to a CRISPR array (as detected by MinCED) were selected resulting in the identification of 118 additional Cas-alpha endonucleases (SEQ ID NO: 254-371) ranging in size from 327-777 amino acids. Phylogenetic analysis (Maximum Likelihood method and JTT matrix-based model (Jones, D. T. et al., (1992) *Computer Applications in the Biosciences* 8: 275-282) using MEGA software (version 10.0.5) (Kumar, S. et al. (2018) *Molecular Biology and Evolution.* 35:1547-1549)) was then performed. It showed the formation of three distinct groups (I, II, and III.) of Cas-alpha nucleases with the majority coming from three lineages of microorganisms, *Candidatus Archaea*, *Clostridia*, and *Bacilli* (FIG. 20). Those loci that also encoded CRISPR-Cas adaption genes (Cas1, Cas2, and optionally Cas4) were only associated with Cas-alpha proteins from Archaea. Other bacteria where Cas-alpha nucleases were identified included organisms belonging to *Aquificae*, *Deltaproteobacteria*, *Bacteroidetes*, *Candidate Levybacterium*, *Negativicutes*, and *Flavobacteriia* (FIG. 20). Additionally, the topology of the cladogram only partially matched the microorganism from which the Cas-alpha endonucleases were identified. Most of the discrepancy came from group III that is present in both *Bacilli* and *Clostrida*, suggesting horizontal transfer between these two classes of microorganisms (FIG. 20).

Example 12: Cas-Alpha RNA-Guided DNA Integrase

In this Example, a Cas-alpha endonuclease and guide polynucleotide in complex with a transposase (for example but not limited to TnpA) can be utilized to site-specifically insert a DNA payload.

Tn7-like genetic mobile elements have captured CRISPR-associated (Cas) proteins (Peters, J. et al. (2017) *Proc. Natl. Acad. Sci. USA.* 114:E7358-E7366) and evolved RNA-guided based mechanisms to copy themselves into new locations and offer to advance genome editing approaches that rely on the insertion of DNA (for examples but not limited to cis- or trans-genes) at specific sites (Strecker, J. et al. (2019) *Science.* 365:48-53 and Klompe, S. et al. (2019) *Nature.* 571:219-225). Here, we find that transposase (Tnp) proteins belonging to IS200/IS605 and IS4 mobile elements are encoded adjacent to some Cas-alpha endonucleases (FIG. 21A). Taken together, this suggests that Cas-alpha endonucleases can be harnessed to function as part of a transposase complex capable of programmable DNA integration (FIG. 21B).

SEQUENCE LISTING (371 sequences)

SEQ ID NO: 1 - protein, 327 aa, Unknown
  Candidatus Micrarchaeota archaeon
MQLIIDDYGAYLGQKDNLFQIRKKDGTCEEYSADKVEQILLVKNSCISSRAALLAARNNIDVVFVGKFGMPEGRIFPACLGGTNLIRRKQLEAGQNEKGGKIAIKLIWAKIKNEEFFLKTLNKSRTAPLLLEKAEKISAIAEQVRQMLGEKFDADRVFGFEGLAAAHYFEGLSQVMPIEKRDQEGKDAPNALLNYGYGMLYGEIEKACLFAGLDPYLGFLHADRYGKPSLVLDLIEEFRPVIVDRAIITLYAQKQINESDFEQGGDKIFLSKEGRKKMIKAIMERLHAKITSDGRKLELSVIIQEQARRIASFVKGESEFEPFLYRW

SEQ ID NO: 2 - protein, 329 aa, Unknown
  Candidatus Micrarchaeota archaeon
MILVINDFSTFLGKKGDRFVIKKENKREEFSTNNVEQIIIAAVSSISYGAIRLAIKHSIDVVFLSRGGTPLGRIYPCKLGGTTLTRKKQLEAYYSTVGTNIVKNLVKAKIMNQAYFLKSLEKTRKDINFTSEINSIVNIAKKIPGLTGLIDDIRGTLLGYEGIAANKYFSSLSNILPFKGRDRTSNDYVNIVLNYGYGVLYTEAEKACILAGLDPYFGFLHKDRYNKPSMVLDLVEIFRPIIVDRAVVTLFSQKQINSKCFEKETYGDVFLSKEGREKILSALLSRLNQQIRFKGKKTSFKNIILGESRSIAQYVLGNIPEYEPFVYRW

SEQ ID NO: 3 - protein, 326 aa, Unknown
  Candidatus Aureabacteria bacterium
MQLVIDDFGTFVKKKQNRFEVARKEKTEEFSADKVSQIVLLKKGTISGSAVALAMEKNIDVVYLDSFGKPIARIFPCTLGGTTLIRRRQAEATASLYAVPYVRAFVKSKMLNQAALLKSLNKTRNGLFLERIREIERIIEKSEDAVGDYVDDLRSALIGYEGNVAAIYFDCIRALIPFGRRKRGAKDRFNSALNYAYGILYSQIEKACLLAGLDPYLGFVHSDRYGKPSLVLDFIEQFRQPIADRAVITIFVKKELADDSFIEEEIVQLSSKGKKKIVEAIYGRLSSEFTHNGKKMTFEKVIIDKAREFAGCILEMKEYEPFVHRW

SEQ ID NO: 4 - protein, 248 aa, Unknown
  Uncultured archaeon
MESNVDIVHLGRRGHPHARVYPCTLGGTTLTRRRQLEAYYAEEGTYLAKQFIMAKIRNQAALLRSLGKSRGNHSLLFSAKAIGKGTNDVDALKGTIDEIRPKLLGMEGNASSVYFGALAGILPFSGRDRNSKDPVNILLNYGYGMLYGEIERACVIAGLDPYLGFMHTDRYGKPSMTLDLIEEFRQPIVDRTLVTLFAQKQIEDADFEAHGDSRLLSRQGREKIIKAVLERLSQKVRRAGAQRHPVSP

SEQ ID NO: 5 - protein, 98 aa, Unknown
  Candidatus Micrarchaeota archaeon
MFYWVIYDISENKKRGRVARICKNYGFRRVQKSAFAGETSKNKVEMLLLECNEIIEGGDDYLFVIPNCTSCFNGKMITGCLDEKRVRNQPYMFVGDGA

SEQ ID NO: 6 - protein, 94 aa, Unknown
  Candidatus Micrarchaeota archaeon
MIYWVIYDITDNKVRSKVAEECKNLGLHRVQKSSFIGILSRNTAEMLYIKIGDLIDKRDCVFFIPQCNKCFADKLILGDFDERTVEAKDFIVVQ

SEQ ID NO: 7 - protein, 100 aa, Unknown
  Candidatus Aureabacteria bacterium
MLYWLIYDISSNSKRLKVSEKCKDYGLYRVQKSAFLGDLSKNKAEMLLEEVQDIMAESEGDCVFMFPACKGCFSSRAIIGEFNESLIEEKEFVFLACSSQ

SEQ ID NO: 8 - protein, 106 aa, Unknown
  Uncultured archaeon
MIYWVIYDISANGTRSRVASACKNYGFKRIQKSAFLGNITKNKADMLAIQCRDMVKEEGDCVFIIPACEQCFRGKEIIGELDEMAGRKLDYLIVGEDGRQTASYGG

SEQ ID NO: 9 - protein, 203 aa, Unknown
  Candidatus Micrarchaeota archaeon
MNRMGILSIRDILNYNYCPRIVYFEYVLRRPQGRTKKEDEGLKQHNEFVPRGKRNKMVKRICYDKKLFNLPLYSPRMNLQTVADCVLIDTKEKLAVPMQFKHGKTPSCLYRTMKYQLVAEALLIEECLGLSCPYGLVKFLPEETTLRTEIDEIQKQKLKEQLESINNVVRFERYPDGPRTRNYCGDCWYHGKVCTGFDGKIVG

SEQ ID NO: 10 - protein, 197 aa, Unknown
  Candidatus Micrarchaeota archaeon
MTTMDGYLTAKDLMNFHYCKRLIYFENVLKIKQATTTKELKGRALHNSFSVSSKRTKIIKEFPYWPKIYNLRLKSDFLHLITTLDCLIINQTDNEAFPLEYKYSKKPRKIYKTMKLQLSLQALLVNELLHYSVKFGFIKFSKDNSLAKVSITDRDLEEVRTTISEVNTIVEKEILPPPTEYKKRCIDCCYFNICKGI

SEQ ID NO: 11 - protein, 189 aa, Unknown
  Candidatus Aureabacteria bacterium
MLKSVTATDVMNFSYCKRIPYYVHVLKIPQFTTVKEYKGREKYDDFKYRSKRSKIIQEFPHLERKYDLYLECDGFSTKLDCVFFNDDDAFPLQLKYAVKPKKMYATTRRQLLLEAFLIEQCLGKKVQRGFVKYELSGDLVEVDLTDKSELFEMFKEYFGIIMGEKLPEPTEYLKRCRDCCYRRFCWGDK

SEQ ID NO: 12 - protein, 138 aa, Unknown
  Uncultured archaeon
MTSSGNPGGTRLYDVTLESKKHGLITKADCILFDREKGEAYPVQHKYSFRPKILYHTYISQLMMEAIIIEEQFNLSVPHGFIVFERSKETVTVDLGDKQKVLYVVGQIRGIIGGEKFPPPTEWKKRCVDCCYNKLCWG

SEQ ID NO: 13 - DNA, 1635 bp, Unknown
  Candidatus Micrarchaeota archaeon
atgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctccatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatga

SEQ ID NO: 14 - DNA, 1761 bp, Unknown
  Candidatus Micrarchaeota archaeon
atgccatccgaaacatacattacgaaaaccttgtcattaaaactcattccatcagatgaagaaaagcaggcgttagaaaactattttataacattccagagggccgtgaattttgctatagatagaatagtagatataagaagctcctttagatatctaaacaaaaatgaacaatttccagccgtgtgtgattgctgtggtaagaaagaaaagataatgtatgtgaatatatccaataaaacctttaagtttaaaccatcaagaaatcagaaggatagatacacgaaggacatttatacaatcaagcccaatgcccacatatgtaagacatgctacagtggcgttgcaggaaatatgtttatacgcaaacaaatgtatccgaacgataaagaagggtggaaagtttcgcgttcatacaatatcaaagttaatgcccctggactgactggaaccgaatatgctatggccatacggaaggcaataagtatattaagatcttttgaaaagcgacgaagaaatgctgaaagaagaatcatagagtatgaaaagtccaaaaaagagtatttagaattgattgatgatgttgaaaaaggaaagacaaataaaatagtggttcttgagaaagaaggccatcagcgagtgaaaagatataaacacaagaattggcctgagaaatggcaaggtatttctttaaataaagcaaaaagtaaggttaaagatattgagaaaagaataaaaaagctcaaggagtggaaacaccctacactaaatcgaccatatgtcgagttacacaaaaataatgttaggatagtgggttatgaaacagtggaacttaaattaggaaacaaaatgtacaccatacattttgctagcatatctaatttacgaaaaccatttagaaaacaaaagaaaaagtccatagaatatctgaaacatctcctaaccctagcgttaaaaagaaatcttgaaacataccccagcataataaaaagaggtaagaatttctttttgcagtatcctgtgcgagtgacagttaaagtgcctaagctgacaaaaaattttaaagcttttggcatcgatagaggcgtaaataggcttgcagtaggttgtataatctcaaaagatggaaaacttaccaataaaaatatttttttcttccatggaaaggaagcgtgggccaaggaaaacagatacaagaagattagggacagattatacgctatggccaagaagttgagaggagataaaaccaagaaaataaggctttatcatgagattaggaagaaatttagacataaagtcaaatatttcaggagaaactatctgcataatatctctaagcaaattgttgagattgcaaaggaaaatacaccgactgtcatcgtattagaagatttacggtacttgagagaaaggacatatagaggaaaaggaagaagcaaaaaggcgaaaaaaacaaattataaattaaatacttttacttacagaatgcttatagatatgataaaatacaaggcagaagaagcgggagttcctgtaatgattattgacccaagaaacacatcacgaaaatgttctaagtgtggttatgttgacgaaaataatagaaaacaagcctcgtttaagtgccttaagtgtggttatagtcttaatgcagacttaaatgcagctgtcaatatagcaaaagctttttatgaatgccccacgtttagatgggaagaaaaattgcatgcatatgtttgttcagagcccgataaatag

SEQ ID NO: 15 - DNA, 1812 bp, Unknown
  Candidatus Aureabacteria bacterium
atgaagtcatttaagctaaagttgttgccaacagatgagcaaaacgttcttttaaatgaagtgttttgtaaatgggcatcattatgtaccagaatggcgtctaaaggacacgataaagaacgactggcgcctcctgattcaagcgggaattattttaacaaaacacaactcaatcaggtgaatactgatgtaactgaccatatgggtgcgcttgaagagtcagcaagtcaaaaagaaagagcagttgagaaagtcaaaagaaggttgaagctgatttcagatatgctctctgagccaaatttaagggatgtttctcaacaaaaaccaaccacgttccgtccattagagtgggttaaggagggtctgttaaaaacaaaataccatactgtgcattattggcaaaaggaatgtgataagttaacaaaacaaaaagaacgaatggagaaaacaattgagaagataaagaaagggaagataacgttcaaaccaacaaagatgtccctgcaccaaaattgtttttcgttatcattcggaaagggaacgttttcaatgcggccttttagcgacactaaacgaggcataaatcttgatatgctaactgctcccattcaacctgcaataggaaaaaacgatggcaaatcatctttgaggagcaaagagtttatcgcaaggaatattgaaaactacattattttttccatccactcacaactatttgggctgagcaggtcagaagaactgttgttaaacgcaaaaaaagaggaactcgttgctaagcgagatgcaatgctcaaaaagaaatctgattcgctaagtaaaaaaataaaggaattagaaaaaatagtaggaagaaaaattactgattcagaacgttcagagataatgtctcagggcggcaaattgtcttctgaaaagttcagtgaagataattcatatttgaaaacgttaaaggtgctggcaaaagacattattgggcgagaggaattgttcagacttaagaagtacccgattgtgattagaaaacctctcaacgaacgaaaaaagctcaaaaatcttaaacctgacgaatgggaatattatttacagttgagttatgatgagttggaaaagaaagagtttacaccaaagacaattatgggaatcgatagaggactaaaacacattcttgctattgcgatttacgaccctgtgcaaaataaatttgtaaaaaatatgctcattccaaatccgatattaggttggaagtggaagttgcgaaagataaaaagaagtattcaacatatggaaaggagaatacgggctcagcaaaatgctcacgttcctgagaatcagttgaaaaaacggttgaaaagtattgagaacaaaattgattattactatcacaatgtgtcgcggcaaatattgaatctcgctcacgatttcaaatcagcaatagtggtagaagacttacagaatatgaaacaacacggaagaaagaaatcaaaaggactaagaggactaaactacgcattaagtaactttgactatggaaaaattatgggtcttgttaagtataaagcagaatcagagaatgtgcctcttcttaccgtgttgcctgcaggaacgagtcaaaattgcgcgtattgtctcttgtacggaaaagaacaaggaaattatgtgcggaataatgtcaacagtaaaataggcaagtgtaagcttcatggagaaatagatgcggacatcaatgcggcaaggacgattgcgatttgttatcataagaatattaatgaaccaaaaccatatggtgaacgaaagacttttaaaagaaagtaa

SEQ ID NO: 16 - DNA, 1590 bp, Unknown
  Uncultured archaeon
atggctaagaatactattacaaaaactctgaaactgagaatagttcgaccatataattctgctgaagtagagaagatagtagctgatgagaaaaacaatagggagaaaatcgccttagaaaaaaataaggataaggttaaagaggcctgtagcaagcatctcaaagttgccgcctattgcacgacgcaagtagaaagaaatgcatgccttttctgcaaagcaagaaaattagacgataagttctaccaaaagctgaggggacaatttcctgatgctgtattttggcaagagatttctgagatattcaggcaattgcagaagcaagctgctgaaatatataatcaaagtctcatcgaactatattacgagatttttataaagggaaaaggaattgcaaatgcttcatcagttgagcattatctcagtgatgtttgttatacaagagctgccgaattattcaaaaatgctgcgatagcaagcggtttaagatcaaagataaagagcaatttcaggctcaaggaattaaaaaatatgaaatcagggcttccgactacaaaatcagacaacttccccattcctcttgtcaagcagaaaggagggcaatataccggctttgagatttcaaatcataattctgatttcatcataaaaattccgtttggcagatggcaagtgaaaaaagagattgataaatacaggccttgggaaaagtttgattttgaacaagtgcagaagtctcctaaacccatctctctcttgctgtccacgcagagaagaaaaagaaacaaagggtggtccaaagatgagggtactgaggcagaaataaagaaagtgatgaatggagattaccaaacaagctatattgaggtaaaaagaggatcgaaaattggggagaagagtgcttggatgcttaatctttctatcgatgtccccaagatcgacaagggagttgatccgtccattataggcggaatcgatgtcggcgtgaaaagcccgcttgtgtgcgctatcaacaatgctttcagtcgttactctatctcggacaatgacctctttcatttcaacaaaaaaatgttcgccagaaggaggatattgcttaagaagaataggcataaaagagcaggacatggtgctaaaaataaacttaagcctatcaccatattaactgaaaaaagcgagagatttaggaagaaactaatcgagaggtgggcgtgcgagattgcagattttttcatcaaaaataaggttggaactgtccaaatggaaaatttggagtccatgaagagaaaagaagacagctacttcaacatcagattgagaggtttttggccttatgcagaaatgcaaaataaaatagaatttaagctcaaacagtatggtatagaaataagaaaagtagcgcctaacaatacctctaaaacgtgctccaaatgtggtcaccttaataactattttaattttgaatacagaaaaaagaacaaatttcctcatttcaagtgtgaaaagtgcaatttcaaggaaaatgcggattataacgccgctttaaatatttccaatccaaaactaaaatcaacaaaggaagaaccatag

SEQ ID NO: 17 - protein, 544 aa, Unknown
  Candidatus Micrarchaeota archaeon
MNMSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 18 - protein, 586 aa, Unknown
  Candidatus Micrarchaeota archaeon
MPSETYITKTLSLKLIPSDEEKQALENYFITFQRAVNFAIDRIVDIRSSFRYLNKNEQFPAVCDCCGKKEKIMYVNISNKTFKFKPSRNQKDRYTKDIYTIKPNAHICKTCYSGVAGNMFIRKQMYPNDKEGWKVSRSYNIKVNAPGLTGTEYAMAIRKAISILRSFEKRRRNAERRIIEYEKSKKEYLELIDDVEKGKTNKIVVLEKEGHQRVKRYKHKNWPEKWQGISLNKAKSKVKDIEKRIKKLKEWKHPTLNRPYVELHKNNVRIVGYETVELKLGNKMYTIHFASISNLRKPFRKQKKKSIEYLKHLLTLALKRNLETYPSIIKRGKNFFLQYPVRVTVKVPKLTKNFKAFGIDRGVNRLAVGCIISKDGKLTNKNIFFFHGKEAWAKENRYKKIRDRLYAMAKKLRGDKTKKIRLYHEIRKKFRHKVKYFRRNYLHNISKQIVEIAKENTPTVIVLEDLRYLRERTYRGKGRSKKAKKTNYKLNTFTYRMLIDMIKYKAEEAGVPVMIIDPRNTSRKCSKCGYVDENNRKQASFKCLKCGYSLNADLNAAVNIAKAFYECPTFRWEEKLHAYVCSEPDK

SEQ ID NO: 19 - protein, 603 aa, Unknown
  Candidatus Aureabacteria bacterium
MKSFKLKLLPTDEQNVLLNEVFCKWASLCTRMASKGHDKERLAPPDSSGNYFNKTQLNQVNTDVTDHMGALEESASQKERAVEKVKRRLKLISDMLSEPNLRDVSQQKPTTFRPLEWVKEGLLKTKYHTVHYWQKECDKLTKQKERMEKTIEKIKKGKITFKPTKMSLHQNCFSLSFGKGTFSMRPFSDTKRGINLDMLTAPIQPAIGKNDGKSSLRSKEFIARNIENYIIFSIHSQLFGLSRSEELLLNAKKEELVAKRDAMLKKKSDSLSKKIKELEKIVGRKITDSERSEIMSQGGKLSSEKFSEDNSYLKTLKVLAKDIIGREELFRLKKYPIVIRKPLNERKKLKNLKPDEWEYYLQLSYDELEKKEFTPKTIMGIDRGLKHILAIAIYDPVQNKFVKNMLIPNPILGWKWKLRKIKRSIQHMERRIRAQQNAHVPENQLKKRLKSIENKIDYYYHNVSRQILNLAHDFKSAIVVEDLQNMKQHGRKKSKGLRGLNYALSNFDYGKIMGLVKYKAESENVPLLTVLPAGTSQNCAYCLLYGKEQGNYVRNNVNSKIGKCKLHGEIDADINAARTIAICYHKNINEPKPYGERKTFKRK

SEQ ID NO: 20 - protein, 529 aa, Unknown
  Uncultured archaeon
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 21 - DNA, 5539 bp, Unknown
  Candidatus Micrarchaeota archaeon
tcgcgtctatggcgtgattttgcagcttccctaaattcagccccttctcctcaaagcccagaagctcctttaatgcctgctcgtttgcgccctccacctttgagcccggggcggcggggaagatgctgcgcaccaatcttccttccttgtagactccaagcgccctaacccttgcgattacatactcccagtccgcagtcgggaaattctgcggcatcggggagcctttctcgtactctgaaacgctttccgcatgctcaaaatagcggtttgcgcgcattatctcggaaattgtgccaaaaagcattccatcctcgcagcgtgtctggacgaactgccccttccttacattcggggaggagattacgaaggagaagaaggaggtggtggggctgtctattgtggagatgaccgtgccaagggaggtggaatccatgaagaggttttgaggagaaaattaatatatggaattgaggggggtcggacttctaccctgtaagtgtttataaggagaactccatatatacttcggatatgcaactaataattgacgattatggcgcatatcttgggcagaaggacaacctcttccaaataaggaagaaagacgggacgtgtgaagaatattctgccgacaaggttgagcagatacttcttgtgaaaaatagctgtatttcttcaagagccgcactcttggcagcacgaaacaacatagatgtagtgtttgtaggaaaattcggaatgccggaaggaaggatttttcctgcatgtcttggaggaacaaatctcataagaagaaaacaacttgaagcagggcagaatgagaaaggagggaaaattgcaataaaacttatctgggcaaagatcaagaatgaggaatttttccttaaaactctcaacaaaagcagaactgcgcctcttcttttggagaaagcggaaaaaataagcgctattgcggagcaagtccggcagatgttaggcgagaaatttgatgcagatagggtttttggttttgaaggattggctgcggcgcactattttgagggattgtcacaggtaatgccgattgaaaagcgcgaccaagagggaaaagatgccccaaatgcactcttgaattatggttatggaatgttgtacggagagatagagaaagcctgcctttttgccggtttggacccgtatcttggctttcttcatgcagataggtacggcaagccctctcttgtacttgatttgatagaagagttcagaccggttattgttgatagggcgattattacgctttacgcacagaaacagataaacgagagtgattttgagcagggaggagataagatttttctttcaaaagaagggagaaagaagatgataaaggcaattatggaaagactgcatgcaaaaataacttcagatgggcgcaagcttgagctttcggtgataatacaggagcaggcgcgaagaatcgcctcctttgtgaagggagagagcgagtttgagccttttctttacaggtggtaggatgttttattgggtaatttatgatataagcgaaaacaagaaacgcggcagggtggcaagaatatgcaaaaactacgggtttagaagagtgcagaagagcgcctttgcaggcgaaacttcaaagaataaggtggagatgctgttattggaatgcaatgagattatagagggaggggatgattatttgtttgtcattccgaactgcacaagctgtttcaatgggaaaatgataaccggctgtcttgacgagaaaagagtgagaaatcagccgtatatgtttgtaggtgatggcgcatgaacagaatgggaattttgagcattcgagacatattgaattacaactactgcccgcgcatagtatattttgagtatgttctgcgcagaccacagggcaggacgaaaaaggaggatgagggattgaaacagcataatgaatttgtgccaagagggaagaggaataagatggttaaacggatttgttatgacaagaagctgtttaatctgccgctttattctccgcgcatgaaccttcaaactgtggcggattgcgtgcttattgacacaaaagagaagcttgctgttccgatgcagtttaagcatggaaaaacaccttcttgcttgtatcggactatgaaataccagcttgtagcggaggcgttgctgattgaggagtgccttgggctttcatgtccttatggacttgtgaaattcttacctgaagaaacaactcttagaacagaaatagacgaaattcaaaagcaaaaacttaaagaacagcttgagagtattaacaacgtggtgaggtttgaaaggtatcccgatggtccgagaacgaggaattactgcggggactgctggtatcatggaaaagtttgcacgggatttgacggcaaaatagtgggatgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctccatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatgatttactccgagtaatcggatgtggattatagcacagcaacctatatggaagctgggaaccggtttatccggaaatgcgcaccgttgcatggaattatgtgcgcttaagaccttatgatatcgcgcggcttgacttcgcgatagacaggtcaactattgtctcggttcaacgtgccaattagcaggtctttataaatagcctgcagattttcaagttgcttttcttagtgcagaaaagaaggcaggagaagcctccgtttggcaaaaaaaggcggttgtatctactgtttcagcgcacgaattaacgagatgagagatgcaacttcactgtcagataaagaataagccactctggtgtccgtttcagcgcacgaattaacgagatgagagatgcaactctgatatttccgagcgttgaggatgtggcaactggggtttcagcgcacgaattaacgagatgagagatgcaactagacaagctcacgaatgtagtagctcatgttgcctttgtttcagcgcacgaattaacgagatgagagatgcaactctctccgcgcaaatcgtatctccatgttccgctccgtttcagcgcacgaattaacgagatgagagatgcaaccagccatttatcttcttatttactatgattgggcgggtttcagcgcacgaattaacgagatgagagatgcaactttctgtcaatccttccgccaatactttgttttcaagtttcagcgcacgaattaacgagatgagagatgcaactggatatagggtatttgagataccccacacgggcttgtttcagcgcacgaattaacgagatgagagatgcaactatgatttactgcgctcgtagttgcgacaaagtggcgtttcagcgcacgaattaacgagatgagagatgcaacaattcagctaccgagtcattccccttcatttttgatgtttcagcgcacgaattaacgagatgagagatgcaacacagtagaagataaaacagaattagaataagatggcttccagcctgatggtcgtgctcataaccgaattgctgaagtatacgtgcaagctcccttccagaaatgacgggcagtttaggcatgtacctcaacaatttcttcccgtattgacggcggaaccggctccccgtgctttttcaggctcgcaagatagcccttgatggcgtctttaacgtttgcaagcgcatcttccctagttgttccctgcgaaacacagcccggaagcgaggtgcaaaccgcgacgtatgcaccgtcttcgtcttcttctacaatcaccctgaatttcataagtatctttgggctttttggagtttataagaatgatggatttgggaagttgcaccgcgcggattagtgggagccccgtcatttcggcgcatccaaaaggagtataagctccctcgtttttgcttcaaattccttttttcttcaattccgcaaatctgcctttgcgggagcttcg

SEQ ID NO: 22 - DNA, 6111 bp, Unknown
  Candidatus Micrarchaeota archaeon
agtttcaatccctccccctgcattgcaacgcagctcgttgcatccgcaggcgatcttcgatcgcctttgcttaagcctttgacacagaaaggataggaaaggcttaaatccctgtgctgttaaaataccagtgaagaggtcaaggcatgaggattgagaagaaaatatggccggagtattttcagaaaataattgatggagtcaaaacctttgagttaaggctggcagattttgagtgcaggcctggtgacatactggttttgagggaatgggacccaagaacaaaagagtacacgggcagagttattgaaaagaaggtcacttacgtggccaaaagcaaagacatgaggtcctggcctgacgaggacataaggaaatatgggtttctggttattgggtttaaatgagcggcggttgatatgttttcaatggtggccatatgattagataatcgacaaacatgcgaatcctttttatatgtgaaaacaagaaataaaacgatgccatccgaaacatacattacgaaaaccttgtcattaaaactcattccatcagatgaagaaaagcaggcgttagaaaactattttataacattccagagggccgtgaattttgctatagatagaatagtagatataagaagctcctttagatatctaaacaaaaatgaacaatttccagccgtgtgtgattgctgtggtaagaaagaaaagataatgtatgtgaatatatccaataaaacctttaagtttaaaccatcaagaaatcagaaggatagatacacgaaggacatttatacaatcaagcccaatgcccacatatgtaagacatgctacagtggcgttgcaggaaatatgtttatacgcaaacaaatgtatccgaacgataaagaagggtggaaagtttcgcgttcatacaatatcaaagttaatgcccctggactgactggaaccgaatatgctatggccatacggaaggcaataagtatattaagatcttttgaaaagcgacgaagaaatgctgaaagaagaatcatagagtatgaaaagtccaaaaaagagtatttagaattgattgatgatgttgaaaaaggaaagacaaataaaatagtggttcttgagaaagaaggccatcagcgagtgaaaagatataaacacaagaattggcctgagaaatggcaaggtatttctttaaataaagcaaaaagtaaggttaaagatattgagaaaagaataaaaaagctcaaggagtggaaacaccctacactaaatcgaccatatgtcgagttacacaaaaataatgttaggatagtgggttatgaaacagtggaacttaaattaggaaacaaaatgtacaccatacattttgctagcatatctaatttacgaaaaccatttagaaaacaaaagaaaaagtccatagaatatctgaaacatctcctaaccctagcgttaaaaagaaatcttgaaacataccccagcataataaaaagaggtaagaatttctttttgcagtatcctgtgcgagtgacagttaaagtgcctaagctgacaaaaaattttaaagcttttggcatcgatagaggcgtaaataggcttgcagtaggttgtataatctcaaaagatggaaaacttaccaataaaaatatttttttcttccatggaaaggaagcgtgggccaaggaaaacagatacaagaagattagggacagattatacgctatggccaagaagttgagaggagataaaaccaagaaaataaggctttatcatgagattaggaagaaatttagacataaagtcaaatatttcaggagaaactatctgcataatatctctaagcaaattgttgagattgcaaaggaaaatacaccgactgtcatcgtattagaagatttacggtacttgagagaaaggacatatagaggaaaaggaagaagcaaaaaggcgaaaaaaacaaattataaattaaatacttttacttacagaatgcttatagatatgataaaatacaaggcagaagaagcgggagttcctgtaatgattattgacccaagaaacacatcacgaaaatgttctaagtgtggttatgttgacgaaaataatagaaaacaagcctcgtttaagtgccttaagtgtggttatagtcttaatgcagacttaaatgcagctgtcaatatagcaaaagctttttatgaatgccccacgtttagatgggaagaaaaattgcatgcatatgtttgttcagagcccgataaatagcaaatttacttattcggagcctgtttaagccattagaaaaagataaatattaagaagcacataatttattttggttacatatcactggataatgagaacagctgtagattaagctgtttgatgtattgtattatgctccactttaataagtggtgccttccaaagctatatgctgagggaggatgggcgctgttgcagcgtctgcccacctcagagtgggtatccttacctattttgaaaggttctgtaagtgtttataaatccgattgcaattttgcaacttacctatttttaagtttcagatatctcgatagacgcagcaatactcaaaaattgtctgccattgcagaacccaaagtaataggtcaaggaatgcaactgactaaacaaagtttcgctaaactagaagaacaggccaattgcagaacccaaagtaataggtcaaggaatgcaactcaatatcagacgctttattcactctaggagctacccttattgcagaacccaaagtaataggtcaaggaatgcaacattatatttattgttatgttatcatatctcccaaacaaaagtattgcagaacccaaagtaataggtcaaggaatgcaactaggtgttgttaagcgacacggttagaaggtaatcttgattattgcagaacccaaagtaataggtcaaggaatgcaactcggcctttttccagccaagggcttttactattgccctattgcagaacccaaagtaataggtcaaggaatgcaaccaagcgaaaagtatttatataacataggtttgtttcattgcagaacccaaagtaataggtcaaggaatgcaactattcttccaaattcaacacctccaaaatatttataattgcagaacccaaagtaataggtcaaggaatgcaacttgacagccaagctagaaagttgttaaacagctttaattgcagaacccaaagtaataggtcaaggaatgcaactatgttaaaatcgctatcgggcgtggaagggggtagcgaattgcagaacccaaagtaataggtcaaggaatgcaaccatagtatccctgcgtttgctctgcaaccgcaggttgtctattgcagaacccaaagtaataggtcaaggaatgcaactctggatatctggtccctccacgaaaccatcaccatcattgcagaacccaaagtaataggtcaaggaatgcaaccaccttttggtatagcccagaagcatcaaaaacatgtgaaaaattgcagaacccaaagtaataggtcaaggaatgcaactctttttagcttttctcggcagtttataccacatatccttattgcagaacccaaagtaataggtcaaggaatgcaacggtaatgtcagcccatctgacgcaacggcatttgagacaattgcagaacccaaagtaataggtcaaggaatgcatgagaaccacataatttttaaattgcaggtacttatcattttttatgattttagtgataaacgatttttcaacattcctggggaagaaaggggaccgttttgtaattaaaaaggaaaataagcgtgaagaattttctacaaataacgttgaacaaatcataattgctgcagtctcatctatctcctatggagctattcgattggcaattaaacactctattgatgtggtttttttaagcagaggaggtactcctttaggcaggatatacccctgtaaactcggtggaacaaccttaacgagaaaaaaacaattagaggcttattattcaacagttggtacaaacatcgtaaaaaatctcgttaaagcaaagattatgaaccaagcctattttttgaagtctttagaaaaaacaagaaaagatattaatttcacttctgaaattaacagcattgttaatattgctaaaaagattccaggtctcacaggtctaatagatgatatacggggaactttattgggatatgaaggcattgcagccaacaaatattttagttccttgtctaacatactaccatttaaaggaagggacagaacaagtaatgattacgtaaatattgtattgaattatggatatggtgttctgtacacggaagcagagaaagcgtgtattctagcaggtcttgatccatatttcggttttttgcacaaagataggtacaacaaaccttcaatggtattggaccttgtggaaatatttagaccaatcatagtggacagggcagttgttactttgttttcccaaaaacagataaattcgaagtgttttgagaaagaaacatatggggatgtttttttaagtaaagagggtagggaaaaaatcttatctgctcttctatctcgcctcaatcagcagatacgctttaaaggtaagaaaacaagctttaaaaacatcatattaggagaaagccgttctatagctcaatatgttcttggtaatataccagaatatgagccgtttgtttataggtggtaattatgatatattgggtgatttatgacatcacagacaataaagttagaagcaaggttgccgaggagtgcaagaacttggggttacatcgagtccaaaaaagttcttttattggcattctctctagaaatacagccgagatgttatatattaaaataggggatttaattgataaaagagattgtgtgttctttattccacaatgtaacaaatgttttgcagacaaacttattcttggcgattttgatgaaaggactgtagaagcaaaagatttcatcgtggtgcaatgacaacgatggatggttatttaactgctaaggatttaatgaactttcattattgtaaaagattaatatattttgagaatgtattgaaaattaaacaagctacaaccaccaaagaactaaaaggtcgcgcattacacaacagtttttctgtatcatcaaagagaaccaagataataaaggagtttccatattggcctaagatatataatcttagattaaaatcagattttttgcaccttataactacattagactgcttgattataaaccaaacagataatgaggcatttccgctggaatacaaatattccaaaaaaccacgcaagatttataaaaccatgaaattgcaactgtctcttcaagcccttctcgtaaatgaacttttacattatagtgtgaagtttggtttcataaagttttccaaagacaattctttggccaaagtaagcataacagatagagatttagaagaagtgagaacgactatatctgaggttaatacaatagtagagaaggagattttacctccacccaccgaatataaaaaaagatgtattgactgttgctatttcaatatatgcaaaggaatctaaacaccctctcacttcacagtcacactcttggccaggtttctgggcctgtcggggtctaggcctttgaggacggccagttggtaggccagtatctggattgggatgatttggaggattgggccgagctcctcgctttcaggcgtttttatccagtagtcaaaaatatcgtaatttttgtgagagactccgatgacataggcccctcttgtttttacctcatttgcgtttgctatgatgtctttgtcatccttggaaacaaagacaataacagggcttcctttttttatcagagccagggggccatgctttagctctcctcctgcaaaggcctctgcgtgtatgtatgacacctccttgatctttagggcagcctccagtgctgttggatactgcagggaccttcctagcacgtatatgtgttcctcatttaagaggcgtttggctaatgccctgagcctgtctctcatgttcctagacgtcaggttgtatatatccatgta

SEQ ID NO: 23 - DNA, 8356 bp, Unknown
  Candidatus Aureabacteria bacterium
tgcgggtgaatcttttatttcttggatgtgtcattaaattaatatattagaaaatatatttttagttatggattttcaacaagttatttttgtggttggtattgttttcggcttattggtggcaggaggcatagtggggtggtacgtcacgcgaatgcgctttatgaggaagtgggatgtgttggttccggaattgcgcaaggatgcgattatgcgttcacgcgcaaacttgggaggaaagtttactgaagcattgtctatgtattttcctgattttccattctctccaacggaaatgagatgggttggaggaagtccaatagattacatcgttttcaaaggtatggataatgataagatagagcaggttgtctttctggaaattaagagcggaaaatcgcagttgtctcctcgggaaaagcagataaaagaggtgattgagaaaaaaggcgttgcgtggaggatgtatcgggctcctgagcagttgacgcggggggaaaatgcagctggtcattgatgattttggcacatttgtgaaaaagaagcagaaccgttttgaggttgcaagaaaggagaaaaccgaggagttctctgcggataaagtaagtcagattgtgcttctaaaaaaagggactatttcaggttcagcagttgcacttgcgatggagaaaaatattgatgttgtctatttagatagttttggaaagccgattgcccgaatttttccgtgcactctgggtggaacaactcttatcaggagaaggcaggcagaggcaactgcatcactgtatgcggttccgtatgtgcgtgcgtttgtcaagtcaaagatgctgaatcaggcggccttgcttaaatcactcaataagacgagaaacggcctatttctggaaagaattcgtgagattgagcggattattgagaaatcagaggatgcagtcggagattatgtggatgacttgcggagtgcgttgatagggtatgagggaaatgttgcggcgatttattttgactgcatacgggcactcattccgtttggaagacgaaagagaggcgcaaaagacagatttaactctgcgttaaactacgcgtatggaattttgtattctcaaatagagaaggcctgtcttcttgcaggtcttgacccgtatttgggatttgttcattctgacaggtacggaaaaccctccttggttcttgactttatcgagcagttcaggcaaccgattgcagaccgtgcagttataaccatttttgtcaaaaaagagttagcagatgattcgttcattgaagaagaaatcgttcagttatcatcgaaaggaaagaaaaaaattgttgaggcaatatatgggcgtctttcatctgaattcacgcataatgggaagaagatgacttttgagaaagtcatcatcgataaggcaagggaatttgcagggtgtattcttgaaatgaaggaatacgaaccattcgttcacaggtggtgaaatgttatattggctcatttacgatatttcaagcaattccaaacggttgaaagtctctgagaagtgcaaagattacggtttataccgtgtacagaaaagtgcatttcttggtgacctatcaaagaataaggcagaaatgcttcttgaagaagttcaggacattatggcggaatctgaaggggactgcgtgtttatgttccctgcgtgcaaagggtgtttttcatcaagagcaattattggggaatttaatgagtcattaatcgaggagaaggagttcgtgtttttggcatgctcaagtcagtgacggcaacagatgtgatgaatttttcttactgtaagagaattccttactatgtccacgttttgaaaattcctcagtttacaacggtgaaagagtataagggacgggagaagtatgatgattttaagtataggtccaagcgttcaaaaattattcaggagtttcctcatttggaaagaaagtatgatttgtatcttgaatgtgatggtttttcaacaaaattggactgtgtttttttcaatgatgatgacgccttccccttgcagctcaagtatgcagtaaaaccgaagaaaatgtacgcgactacgcgaaggcaattgcttcttgaggcgtttttaatcgagcaatgtcttggcaagaaagttcaaaggggttttgtgaagtacgagttatcaggcgacttggtggaagttgacctaactgacaagtctgaactgttcgaaatgttcaaagaatattttggcataataatgggggaaaaactgcctgaaccgacggaatatttaaaaagatgccgcgattgttgttatcgtaggttttgttggggagataaatgaagtcatttaagctaaagttgttgccaacagatgagcaaaacgttcttttaaatgaagtgttttgtaaatgggcatcattatgtaccagaatggcgtctaaaggacacgataaagaacgactggcgcctcctgattcaagcgggaattattttaacaaaacacaactcaatcaggtgaatactgatgtaactgaccatatgggtgcgcttgaagagtcagcaagtcaaaaagaaagagcagttgagaaagtcaaaagaaggttgaagctgatttcagatatgctctctgagccaaatttaagggatgtttctcaacaaaaaccaaccacgttccgtccattagagtgggttaaggagggtctgttaaaaacaaaataccatactgtgcattattggcaaaaggaatgtgataagttaacaaaacaaaaagaacgaatggagaaaacaattgagaagataaagaaagggaagataacgttcaaaccaacaaagatgtccctgcaccaaaattgtttttcgttatcattcggaaagggaacgttttcaatgcggccttttagcgacactaaacgaggcataaatcttgatatgctaactgctcccattcaacctgcaataggaaaaaacgatggcaaatcatctttgaggagcaaagagtttatcgcaaggaatattgaaaactacattattttttccatccactcacaactatttgggctgagcaggtcagaagaactgttgttaaacgcaaaaaaagaggaactcgttgctaagcgagatgcaatgctcaaaaagaaatctgattcgctaagtaaaaaaataaaggaattagaaaaaatagtaggaagaaaaattactgattcagaacgttcagagataatgtctcagggcggcaaattgtcttctgaaaagttcagtgaagataattcatatttgaaaacgttaaaggtgctggcaaaagacattattgggcgagaggaattgttcagacttaagaagtacccgattgtgattagaaaacctctcaacgaacgaaaaaagctcaaaaatcttaaacctgacgaatgggaatattatttacagttgagttatgatgagttggaaaagaaagagtttacaccaaagacaattatgggaatcgatagaggactaaaacacattcttgctattgcgatttacgaccctgtgcaaaataaatttgtaaaaaatatgctcattccaaatccgatattaggttggaagtggaagttgcgaaagataaaaagaagtattcaacatatggaaaggagaatacgggctcagcaaaatgctcacgttcctgagaatcagttgaaaaaacggttgaaaagtattgagaacaaaattgattattactatcacaatgtgtcgcggcaaatattgaatctcgctcacgatttcaaatcagcaatagtggtagaagacttacagaatatgaaacaacacggaagaaagaaatcaaaaggactaagaggactaaactacgcattaagtaactttgactatggaaaaattatgggtcttgttaagtataaagcagaatcagagaatgtgcctcttcttaccgtgttgcctgcaggaacgagtcaaaattgcgcgtattgtctcttgtacggaaaagaacaaggaaattatgtgcggaataatgtcaacagtaaaataggcaagtgtaagcttcatggagaaatagatgcggacatcaatgcggcaaggacgattgcgatttgttatcataagaatattaatgaaccaaaaccatatggtgaacgaaagacttttaaaagaaagtaaattggaatatccttgatgcgaggaatatgcaatcatagtccttaaggcaccgtgtatacaaacggatatgtcttcgagcaatcgaaacatcccaaggatagcacaaattctatatgggtttgtgccaaagatggcccgttgcaggccattagggttcataaaacactgtcatggtgtataacgacctgacctattctctactctaagaacatctcaaccaaataaaacagcaggtctttaaaaagggagctacaaagtcccgacctgctgttttcatttttaaataaaaagagaaaacgcaagtgctgttgcagatgtggagaaatagagataacgaatgcaacatcgtgatttcttggcccatacttcctccatgtagagcgttgcagatgtggagaaatagagataacgaatgcaacgcatatatcaccttgtcatcatattgacgacagaaaggttgcagatgtggagaaatagagataacgaatgcaacaagtcaggactgttaagaatgatgggtcttcttttgtcggttgcagatgtggagaaatagagataacgaatgcaactcgagataccagtggagggtttagatgaagatactgcacgttgcagatgtggagaaatagagataacgaatgcaacagaatttgtgcaaggcgatgggttggcgcagttttgaggttgcagatgtggagaaatagagataacgaatgcaactaaggatagagggtgtctctgcgattgtcacgagaacagttgcagatgtggagaaatagagataacgaatgcaacatagagactgacccgcgctgcaagacgcgtaaggcggttgcagatgtggagaaatagagataacgaatgcaaccgactggattgcttctttctggagctgcggcaaggggttgcagatgtggagaaatagagataacgaatgcaacaggtactccttccaaagcccacttcgctctcccgtaataccgttgcagatgtggagaaatagagataacgaatgcaactgcgggagagactgattgttctgcggcggggagttttgttgcagatgtggagaaatagagataacgaatgcaactgatcccgtgaggatgaaagaaggaacgtccacgtgttgcagatgtggagaaatagagataacgaatgcaacaggtggttagcacgatggagatggacagcccgcaagcgttgcagatgtggagaaatagagataacgaatgcaacttcttgcagcttttggggtgacattgattgcgtttggtgttgcagatgtggagaaatagagataacgaatgcaaccggatgtaacagctaaccctgctacagcgacgaaaggcgttgcagatgtggagaaatagagataacgaatgcaacaccttggccattgttcagtcccagatgccatcaagcgttgcagatgtggagaaatagagataacgaatgcaacaacttcttcgcttgcgccttacgcgccgtaaactcatgttgcagatgtggagaaatagagataacgaatgcaacctgtcaggcgcggacgtcctcacattgttggccgaagttgcagatgtggagaaatagagataacgaatgcaacagaacttcgcaggcatcattaagagcggcagctaccagttgcagatgtggagaaatagagataacgaatgcaaccccgaaaatgtaggcaagaatcgccgccccaatattcgttgcagatgtggagaaatagagataacgaatgcaacttgttttattttgaagcagaggataacacgatgaagaagttgcagatgtggagaaatagagataacgaatgcaactaagaagggttttgcgagtatcaaactcgtcttttacggttgcagatgtggagaaatagagataacgaatgcaacttcgcttagaaatgaccgtcatcaacagatcataatgcagttgcagatgtggagaaatagagataacgaatgcaaccaaggtatatgatgcgacgggtagtttggtgctcaatgttgcagatgtggagaaatagagataacgaatgcaactctcataccaaatccacctctgcactttttgaaaatgggttgcagatgtggagaaatagagataacgaatgcaacaaaaaccctctgatgaatatcgtgaccaagagcaaaggttgcagatgtggagaaatagagataacgaatgcaacggaacacctcctacgcgaaaaccctcgacgatatttgttgcagatgtggagaaatagagataacgaatgcaacttcaggatgtggagcttttcgattttaaaccgaagaaggttgcagatgtggagaaatagagataacgaatgcaactctccttgatgttgtgattggttccgccctgtttgtttgttgcagatgtggagaaatagagataacgaatgcaactttatttgggcgttgtcgattcggagggagagggaatggttgcagatgtggagaaatagagataacgaatgcaacctatcgccataactagccacattactcttttcaataatgttgcagatgtggagaaatagagataacgaatgcaactgatgggattaatttggtgtggcagatgctcaatgagttcagttgcagatgtggagaaatagagataacgaatgcaaccaaatcaatggggtcgcaacgggcactttggtgacgttgcagatgtggagaaatagagataacgaatgcaaccctaacgtgcgaaacttcacccaaacattaactgtatgttgcagatgtggagaaatagagataacgaatgcaacaacttgtggatgggttttccccagatcacggtttcgatgttgcagatgtggagaaatagagataacgaatgcaacaaaatatcgtacaccattatccggcgaagtgccttacagttgcagatgtggagaaatagagataacgaatgcaacaaactccctccgaaaagtgggaagtggcggggtgcaggttgcagatgtggagaaatagagataacgaatgcaacggctggatgaaaaagcacttggtgcctgcgtcctgccgttgcagatgtggagaaatagagataacgaatgcaactcattgcggggcctccttttccagcgctttgagcgcggttgcagatgtggagaaatagagataacgaatgcaacttcttgattgacttgacttctccggccgcctcaagaatgttgcagatgtggagaaatagagataacgaatgcaacgtgagggcgggatgctttgtcgaaaaatgacggtaagttgcagatgtggagaaatagagataacgaatgcaacagtgatgcttccccagaagacaaccaagcacaccaacgcgttgcagatgtggagaaatagagataacgaatgcaacctcgtcaaggttcttgtagttgaagatgaatagcaccgcgttgcagatgtggagaaatagagataacgaatgcaacaggtgccgcctcaacagcgcatcctctggggccaaggagttgcagatgtggagaaatagagataacgaatgcaacggtagaagtcgatgtcttgaacgctgttgttggtcacggttgcagatgtggagaaatagagataacgaatgcaacgcaaattcgggaaaccttcagccatcagcacaccccccgttgcagatgtggagaaatagagataacgaatgcaactacggccgtactgctctcgtcaattccacgcctgtattggttgcagatgtggagaaatagagataacgaatgcaacggtgattggatggagttgtatggtcttgattgtgatttgttgcagatgtggagaaatagagataacgaatgcaacagagtcatcagacgacggatagtaaggtgtatgctgggttgcagatgtggagaaatagagataacgaatgcaactgataaaagtcccatcttgagtacctcatccaagcaggttgcagatgtggagaaatagagataacgaatgcaacgtgataagaagatattagtgcttactggcaggatagagttgcagatgtggagaaatagagataacgaatgcaactaatggcgcgccgttttttaatcgtgccgctctcataagttgcagatgtggagaaatagagataacgaatgcaactcggtttcttcaatcttgcgtgatgcgggaattcctcagttgcagatgtggagaaatagag

SEQ ID NO: 24 - DNA, 5479 bp, Unknown
  Uncultured archaeon
gctgtagtggaattcctccgcggagaccagccccgcatccaccagctgcctcaggttgtagtgcaccgtcgagagagggatcccgagcttctgcgcaacccccgattccgtggcgtccttatcggacagcacgtcgaggatcttcctgcacgactcgttggacacggcgttcgccaccttcttcgtggccttgtcctccagcgagagcatgaggaacttcttgtctgccatatcgggcattccggtgattggtttataaatacttttggataggtttgaatagggttgaagtgatgaacaaaaaccactggacagtggacaaccacgtggatacactatataaaccgattttatttccctatgcagatgatgttggtggtggacaattacaagaccttcatagggaaagaaggcaaccgttttgtacttttaacggaagagcagaagcaggagcattctgctgatcaggtcaggcagattgtcgtcgtcaatggctggcaatggagagcaacgtggatatcgtacaccttggcaggcggggccatccccacgcccgcgtctatccctgcactcttggcggcacgacgctcactaggagaaggcagctggaagcgtattatgcggaggaaggcacatatctggccaagcagtttatcatggccaagatacgcaaccaggcagctctcttaagatcgcttggaaaatcccggggcaatcattctcttctcttctcggctaaggcaataggaaagggcaccaatgacgttgatgcactgaaaggcactattgatgaaattcgcccgaagcttctcggaatggagggcaatgcaagcagcgtctattttggggcccttgcaggaattcttccatttagcggcagggacaggaattcaaaagatccggtcaatatccttctcaactatggctacggaatgctctatggggaaatcgagcgtgcgtgcgtcatcgcgggccttgacccctatctcgggtttatgcacacggacaggtatggcaagccttccatgacgctggacttgatagaggaattccggcagcccattgtggatcgcaccctggttactctttttgcgcagaagcagattgaagatgccgattttgaggcacatggggactcccgcctcttgagcaggcaggggagggaaaaaatcatcaaggcagtccttgagcgcctgagccagaaagtccgtcgagcaggcgcgcaacgtcacccggtttctccttgacagaaagcaggaataccggggattcacgagcaggtggtgagcatgatctactgggtgatttacgacatcagcgcaaacgggacgcgcagcagagtggcttccgcgtgcaagaactacggattcaagcgcatccagaagagcgcgtttctgggcaacatcaccaaaaacaaggcggacatgctcgccatccagtgcagggacatggtgaaggaggaaggcgactgcgtcttcatcatcccggcgtgcgagcagtgcttcaggggaaaggagataatcggggaactcgatgagatggcggggcggaagctcgactacctgatagtgggggaagatggacgacagacagcgtcttacggcggctgacctgctcaattactgctactgcccgcgcattgtctattacgtgcacgtgctgaagctggcgcaggcgacgaccacaaaggaactgaagggaagggagaagtacgatgacttcaagcggaaatccaggcggaacaagattgtacgacgtgactcttgagtcaaagaagcacggcctcatcaccaaggcggactgcatcctctttgacagggagaagggcgaggcataccccgttcagcataagtacagcttcaggccgaagattctctatcacacttacatctcccaactgatgatggaggcgatcattatcgaggagcaattcaatctttctgttccccatggatttatcgtatttgaaaggtcaaaggagacagtgactgttgatttgggggacaagcagaaagttttatatgtcgtggggcagataaggggaattattgggggagaaaagttcccgccgccgacggaatggaaaaagcggtgcgtggactgctgctataacaagctgtgttgggggtaagatggctaagaatactattacaaaaactctgaaactgagaatagttcgaccatataattctgctgaagtagagaagatagtagctgatgagaaaaacaatagggagaaaatcgccttagaaaaaaataaggataaggttaaagaggcctgtagcaagcatctcaaagttgccgcctattgcacgacgcaagtagaaagaaatgcatgccttttctgcaaagcaagaaaattagacgataagttctaccaaaagctgaggggacaatttcctgatgctgtattttggcaagagatttctgagatattcaggcaattgcagaagcaagctgctgaaatatataatcaaagtctcatcgaactatattacgagatttttataaagggaaaaggaattgcaaatgcttcatcagttgagcattatctcagtgatgtttgttatacaagagctgccgaattattcaaaaatgctgcgatagcaagcggtttaagatcaaagataaagagcaatttcaggctcaaggaattaaaaaatatgaaatcagggcttccgactacaaaatcagacaacttccccattcctcttgtcaagcagaaaggagggcaatataccggctttgagatttcaaatcataattctgatttcatcataaaaattccgtttggcagatggcaagtgaaaaaagagattgataaatacaggccttgggaaaagtttgattttgaacaagtgcagaagtctcctaaacccatctctctcttgctgtccacgcagagaagaaaaagaaacaaagggtggtccaaagatgagggtactgaggcagaaataaagaaagtgatgaatggagattaccaaacaagctatattgaggtaaaaagaggatcgaaaattggggagaagagtgcttggatgcttaatctttctatcgatgtccccaagatcgacaagggagttgatccgtccattataggcggaatcgatgtcggcgtgaaaagcccgcttgtgtgcgctatcaacaatgctttcagtcgttactctatctcggacaatgacctctttcatttcaacaaaaaaatgttcgccagaaggaggatattgcttaagaagaataggcataaaagagcaggacatggtgctaaaaataaacttaagcctatcaccatattaactgaaaaaagcgagagatttaggaagaaactaatcgagaggtgggcgtgcgagattgcagattttttcatcaaaaataaggttggaactgtccaaatggaaaatttggagtccatgaagagaaaagaagacagctacttcaacatcagattgagaggtttttggccttatgcagaaatgcaaaataaaatagaatttaagctcaaacagtatggtatagaaataagaaaagtagcgcctaacaatacctctaaaacgtgctccaaatgtggtcaccttaataactattttaattttgaatacagaaaaaagaacaaatttcctcatttcaagtgtgaaaagtgcaatttcaaggaaaatgcggattataacgccgctttaaatatttccaatccaaaactaaaatcaacaaaggaagaaccatagatatttatactttattatccttcattgacaaaaatgagaatgttatcccagataacatttgatgtacacagattcacacttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaaaggtgagtccttataaaccggcgtgcagaacgccggctcaccttttttcttcattcgattttatgcttaaaagccgtaaaaacgcggaattcggcgccgttgcagaacccgaatagacgaatgaaggaatgcaaccatactctgccttagtgttggtgcaataatgtatagttgcagaacccgaatagacgaatgaaggaatgcaactacacctcaagcaagcatccttccagtaatacaaagttgcagaacccgaatagacgaatgaaggaatgcaacaatcaaacaaacatctaacggcaatccaattcttgttgcagaacccgaatagacgaatgaaggaatgcaactggaatggaacaagcccagatacaaacaaaacattgttgcagaacccgaatagacgaatgaaggaatgcaacttgaatcccaccaatccttccctaatttttggttgtagagttgcagaacccgaatagacgaatgaaggaatgcaactcgacttcctgcgtggaaagcagggagacagaatgttgcagaacccgaatagacgaatgaaggaatgcaacctcccatttaggaatgaaaacgcgggcatagttcgttgcagaacccgaatagacgaatgaaggaatgcaacacaatatacccccactagatgggtttgcatagcttagttgcagaacccgaatagacgaatgaaggaatgcaaccgtaagttattgcttcatggcttcccaagagggagttgcagaacccgaatagacgaatgaaggaatgcaactcaacaccaacagcatctccgtgaaagatagtgtcgttgcagaacccgaatagacgaatgaaggaatgcaaccaacaacagcgaccgagggcggccactgtcgatgtgttgcagaacccgaatagacgaatgaaggaatgcaacctgcgccagccgttgagttaaatccggcaaggagttgcagaacccgaatagacgaatgaaggaatgcaacatgatctcctggccgacgtaaagcgtcaatcgttgcttgttgcagaacccgaatagacgaatgaaggaatgcaactttttgcctttacttctgcgtcgtatgacatcttgttgcagaacccgaatagacgaatgaaggaatgcaacaacagagtcccgaataatccagactttgaggcaagttgcagaacccgaatagacgaatgaaggaatgcaactgggaagccgcttcctgacatctcaaagcaagtctgttgcagaacccgaatagacgaatgaaggaatgcaacgagatggaaaaggttaatcttcgtcaggaatatattgttgcagaacccgaatagacgaatgaaggaatgcaatcttgacagagcccgattgcgttatctccaggagaaacatataaaagcatcaaccgctgatcggaatgatatccaaaaacatggccaccatcacccgatggattgaggagcgggcacgatattccacccccatcatccgcatctcccttgccctc

SEQ ID NO: 25 - DNA, 1842 bp, Unknown
  Candidatus Micrarchaeota archaeon
atgatttcactcaaacttaaactgcttccagacgaagaacaaaagaaattgcttgacgaaatgttttggaagtgggcctcgatttgtacccgcgttggttttgggcgggctgataaagaagatttaaaaccgccaaaagacgcggaaggggtttggtttagtttaacacaattaaatcaagccaacacagacattaacgacttaagggaggcgatgaagcaccaaaaacaccgcctagaatacgaaaaaaaccgtttggaagcgcaaagagatgatactcaggatgccttgaaaaatccggacagacgagaaataagcactaaaagaaaggatttattccgtcccaaagcgtccgtcgaaaaaggctttctgaaactgaagtatcatcaagagcgttattgggttcgaaggctgaaagaaataaacaaactaattgaaaggaaaacgaagacacttataaaaatagaaaaggggcgaatcaaattcaaggcaacgcgaataaccctgcaccaaggctcttttaaaattagattcggcgataaacccgcttttctgataaaggcgttgtctggaaaaaaccaaatagacgctccttttgttgtagtgccagaacaaccaatctgcgggagcgttgtaaatagcaagaaatacttagatgaaattactactaatttcttggcttacagcgtaaatgcaatgcttttcggtttgagccgcagcgaggaaatgttgttgaaagccaaaaggccagaaaaaatcaagaaaaaagaagaaaaacttgctaaaaaacaatcagcctttgaaaacaaaaagaaggaattgcaaaaattacttggtagagaactaacccagcaggaagaagcgattattgaagaaacccgcaaccaattctttcaagattttgaggtgaaaataaccaaacaatactcggaattactcagcaaaattgctaacgaactcaagcaaaaaaatgattttctgaaagtaaacaaatatcctatacttttaaggaaacctctcaagaaagccaaatcgaaaaaaattaataatctttcgccaagcgaatggaaatattacctccaattcggagttaaacctttactaaaacaaaaatcaagacgaaaatcaaggaatgttttgggaatagaccgcggccttaaacacttgctagccgtaaccgttcttgaacccgacaaaaaaacgtttgtatggaacaaactttacccaaacccaattacgggctggaagtggaggcgacgcaagcttttgcgctccttaaagcgattgaagaggcgcattaaatcgcaaaaacacgaaacaattcatgaaaaccaaacgaggaaaaagctcaagagtttacaaggcaggatagatgacctgcttcataatatttccagaaaaatagtggagaccgcaaaagaatatgatgcggtaatagtagtggaagacctccaaagcatgcggcaacacggtcgttcaaaaggcaatcgtttgaaaacactgaattacgcgctaagccttttcgattacgcaaacgtgatgcaacttataaagtacaaggcgggtatagaaggaatccaaatatatgacgttaaaccagctggcacaagccaaaattgcgcgtattgccttttagcgcaaagggattcacacgaatacaaaagaagccaagaaaactccaaaataggtgtttgcttaaatcctaactgccaaaaccacaagaaacaaattgacgctgacctaaacgcggcaagagtaatagctagttgttacgccttaaaaattaatgattcccaaccatttggaacaaggaaaagatttaaaaaaagaacaacgaattaa

SEQ ID NO: 26 - DNA, 1503 bp, Unknown
  Uncultured archaeon
atggaagtacaaaaaactgtgatgaagacactttctttgagaatattaagacctctgtactcacaagaaatagaaaaagagattaaagaagaaaaagaaagaagaaaacaagccggaggaactggagagcttgacgggggattttataaaaagcttgagaagaagcattcagagatgttcagctttgataggttaaacttattgttgaatcaattacaaagagaaattgctaaggtctacaatcatgccatcagtgaattgtatatagcgactatcgctcaaggtaacaagagcaacaaacattatattagtagtattgtctataatcgagcatatggatacttttataacgcttacatagccttagggatatgttcaaaagttgaagcaaattttagatccaatgaactcctaacacaacaaagcgcattgcctacagcaaagtcagataattttccaatagttttacataaacaaaaaggtgctgagggagaggatggaggatttaggatatctactgaggggagcgatctgatatttgagatacccattccgttctatgaatataatggggagaaccgaaaagaaccctataaatgggttaaaaaaggaggacaaaaacctgtgttaaaacttatactttctacttttaggagacaaagaaataaggggtgggcaaaagacgagggcacggatgcggaaataagaaaggttacagaagggaagtatcaagtcagccaaatagaaataaataggggtaaaaaactaggagaacatcaaaaatggtttgccaatttcagcatagagcaaccaatttatgaaagaaaacctaatcggagtattgtcggcggattagacgtgggaataagatcccccctagtatgtgcaattaacaactcattttcgagatattctgttgattccaatgatgtatttaagttttctaaacaagtattcgcatttagaagacggctattatcgaaaaactctttgaaaaggaaaggtcatggggcggctcataagttagaacctatcacggaaatgacagaaaaaaatgacaagtttagaaagaaaataattgagagatgggccaaggaagttacaaatttctttgttaaaaaccaagtaggaattgttcagatagaagatttatcaacgatgaaagacagagaggatcatttttttaatcaatatcttagaggattttggccttattaccaaatgcagacattaattgagaacaagctcaaagagtatgggattgaggtaaaaagggtacaggcaaaatatacgtctcagttgtgctcaaaccctaattgcaggtattggaataactattttaactttgaataccgaaaagtaaataaattcccaaaatttaaatgtgaaaagtgtaacttagaaataagtgctgactataacgctgctcgcaatctatcaactcccgatatagagaaatttgtggcaaaagctacaaaaggcattaatttgccagaaaaatga

SEQ ID NO: 27 - DNA, 1275 bp, Parageobacillus thermoglucosidasius
atgaagtatacgaaagtaatgaggtatcaaattatcaaacccttaaacgcagaatgggatgaattgggaatggttctccgtgacatccagaaagaaactcgcgcggcattaaacaagacgattcaattgtgttgggaatatcaaggatttagtgcggattataagcagatacacggtcagtatcctaaaccaaaagatgttttaggatacacaagtatgcacggatatgcttatgatcgtctcaaaaatgaattcagcaaaattgcaagttcaaacctttcgcaaactatcaaacgagcggtagataaatggaatagtgacttaaaagaaattctgcgtggtgaccgctccatccctaacttcagaaaagattgtccaattgatatcgttaagcaatcgacgaaaatacaaaaatgtaatgatggatacgtattaagcctcggtttaattaatagagagtataaaaatgaattgggacggaaaaacggagtatttgatgtacttataaaagcaaacgataaaacccagcaaaccatattagaacgaattataaatggcgattatacatatacggcatctcaaataatcaatcataaaaataagtggtttattaaccttacctatcaatttgaaactaaagaaacagccttagatcccaataatgtcatgggagttgatctaggaattgtttatcctgtttatatagcatttaataacagtcttcaccgttatcatattaaaggaggagaaatagaacgattcagacggcaagtagaaaaaaggaagagggaattgttaaatcaaggcaaatattgtggagacgggcgtaaagggcatggttatgctacaagaacaaagtccattgaatcaattagcgataaaattgcgagatttcgtgacacttgcaatcataaatattccaggtttattgtagatatggcgcttaaacataattgtgggataattcaaatggaagatttgactggaattagcaaggaaagtacatttttgaaaaattggacatattacgatcttcagcagaaaatcgaatataaggcacgagaagcaggaatacaagttataaaaattgaaccccaatatacatctcaacgttgtagtaaatgtggctatattgataaagagaatcggcaagaacaagctacatttaagtgcatcgaatgtggttttaagacaaatgctgactataatgcagcaaggaatatcgcaataccgaacattgacaagataataaggaaaacgttaaaaatgcaataa

SEQ ID NO: 28 - DNA, 1269 bp, Acidibacillus sulfuroxidans
atgatcaaagtatatcggtatgagatcgtaaaaccgcttgatttagattggaaagagtttggaactattttacgacagttacaacaggaaactcgttttgccttaaacaaagcgactcaactggcttgggaatggatgggctttagtagtgattataaggataatcatggggaatatccaaaaagtaaagacattctcggatacacgaatgttcacggatacgcttaccatacgatcaaaaccaaagcatatcgcttaaacagtggtaatttatctcaaaccatcaaacgtgcgacggatcgttttaaagcatatcaaaaggaaatcttacgtggcgatatgtccattccgtcctataaacgagatattccactcgatctgattaaagagaatatcagcgtaaatcgtatgaatcacggggattatatcgcttcgttatctctgttaagcaatccagccaagcaagaaatgaatgtaaagaggaaaatttcggtcataatcattgtccgtggcgcagggaaaacaatcatggacagaatcctaagtggtgaataccaagtctctgcttcacaaataattcacgatgatcgaaaaaacaaatggtatttaaacataagttatgattttgaaccccaaacccgagtgttggatctaaataaaataatggggattgatttaggcgttgctgttgccgtttacatggcatttcaacatacccctgctcgatacaaattggagggaggtgagattgaaaattttcgtagacaggtagaatctcgacggattagtatgttacgtcaaggtaaatatgccggtggtgcccgtggagggcatgggcgagataaaagaataaaaccgattgaacagcttcgagataaaattgctaattttagagataccacaaaccatcgttatagtagatatatagtggatatggcaattaaagaaggttgtggaacgattcagatggaggatttaacgaatatacgcgatattggatctcgatttttacaaaattggacctattatgatttgcagcaaaaaattatttataaagccgaagaggcaggaattaaagtcataaagatcgatccccaatataccagtcaacgttgtagtgaatgtggtaatatagattccgggaatcgaattggacaagctatctttaaatgcagagcttgcggatacgaagccaatgcagactacaatgctgcacgaaacatagcaataccgaacattgacaaaattatagctgagagtatcaaataa

SEQ ID NO: 29 - DNA, 1323 bp, Ruminococcus sp.
ctggtcaaagtcgtaaaaatccatctaattagtgagcaatttgacaaagcaggcaaccggatagattatgaagaagtcaataaaatactgtgggaattgcaaaagcagacacgagaagcaaagaataaaactgttcagcttctttgggaatggaacaatttttcaagcgattatgttaaggcgagtggcatatatcctaaagcaaaagacatatttggctactcaagtgtgcatggacaagcaaacaaagaattaagaacaaaactcgctttaaattcaagtaatctttccactaccacaatggacgtatgtaaaaattttaatacatataaaaaagaggtatggaaaggcaaacgatcagttccttcgtacaaatcagaccaacctcttgatctgcacaaagactctataaagctgatatatgaaaacaacgaattttatgttaggctcgctttattaaaaaaagctgaatttgcaaagtatggttttaaagacggttttcgttttaaaatgcaggtgaaagataattctaccaaaactattcttgaacgctgttttgacgaagtatacaaaataaatgccagcaaacttttatatgaccaaaagaaaaagaagtggaagcttaatctgtcttatagtttcgacaataaaaacatttctgaacttgacaaagaaaagatccttggtgttgatgtaggcgttaactgtcctttagtcgcttcggttttcggcgatcgtgaccgattcataatcaagggcggcgaaattgaaaaattcagaaaaagcgtggaagctcgcagacgttcaatgctcgagcaaacaaaatactgcggtgacggaagaattggtcacggcagaaaaaaacgcactgagcctgccctaaatataggcgacaagatagcaagatttcgtgatacaacaaaccacaaatacagcagagctttgatagaatatgctgtaaaaaagggctgcggaactatccaaatggaaaagctgacgggtattacatctaaatctgatcgttttctaaaagactggacttattatgacctccagacaaagatagaaaacaaggcgaaagaagtagggataaatgtcgtctatatcgcccctaaatatacaagtcagagatgtagcaaatgcggatatatccacaaggataacagaccaaatcaggcgaaatttagatgtcttgaatgcgattttgaaagtaatgcagattataatgcaagtcagaatatcggaattaaaaacattgataagataatagaaaaagatttgcaaaagcaagaaagcgaagtccaagtgaacgaaaacaagtag

SEQ ID NO: 30 - DNA, 1494 bp, Syntrophomonas palmitatica
atgggcgaatcggtaaaagcaataaaattaaagatactggatatgtttttagaccccgaatgcacaaagcaggatgataactggcgcaaagatttgtctactatgtccagattctgcgctgaagcggggaatatgtgtctgcgcgacctgtataattacttttcaatgcccaaggaagaccgtatttcctcaaaagacttatataacgctatgtatcataaaactaaacttctccatcctgaattaccaggtaaggtagcgaaccaaatagtaaaccacgctaaagatgtttggaaacgcaacgctaaactcatttatcggaaccaaatctcaatgcctacatataagataacaacagcaccaatccggctgcaaaataacatttataaattaataaaaaataagaacaaatacataatagacgtacagttatactccaaggaatactccaaggatagtggtaaaggcactcataggtattttctggtagcagttagagactcatcaacccgtatgatattcgaccgtattatgagtaaggaccatattgacagtagtaaatcatacacgcaaggacaactccaaatcaagaaagaccaccaggggaaatggtattgcatcataccctatacattccctacacatgagacagtcctcgaccctgataaagtcatgggagtagaccttggcgttgcaaaagctgtttactgggcgtttaatagttcttataaaagaggctgtatcgacggtggggaaatagaacatttccgcaaaatgatacgagctcgcagggtgtccatccaaaatcaaatcaaacattcaggggacgcccgtaaaggacatgggcgcaaaagggcgttaaaacccatagaaacattgagcgagaaggaaaagaattttagggatacaataaaccaccgctatgcaaatcgaattgtagaagctgctattaagcaaggctgtgggacaatccaaatcgaaaaccttgaaggtatagctgacacaacaggcagtaaatttctcaagaactggccttattacgacctgcagacaaaaattgttaataaagccaaggaacatggcattaccgttgttgcaataaacccccaatatacatcccaaaggtgttcgatgtgcgggtatattgaaaaaaccaaccgttcatcacaggcagtatttgaatgtaaacaatgcggttacggcagtaggactatatgtattaactgcaggcacgtccaagtatccggggatgtttgtgaggaatgtggcggcatagtaaaaaaagaaaacgtaaacgcagactacaatgcggcaaaaaacatatccacaccgtacatcgaccagataataatggagaagtgtttagaactaggtattccttaccgcagtataacctgtaaagaatgtggtcacatacaggcttcaggaaatacctgcgaggtttgcggaagtactaatattttgaaaccaaagaaaattagaaaagcaaaataa

SEQ ID NO: 31 - DNA, 1494 bp, Clostridium novyi
atgattacagttagaaaaataaagttaacaataatgggagataaagatacaagaaatagtcaatacaaatggattagagatgaacaatacaatcagtacagagctttaaatatgggtatgacttatttagctgtaaatgatattttatatatgaatgaaagcggattagaaattcgaactattaaagatttaaaagattgtgaaaaagatattgataaaaataaaaaagaaattgaaaagttaactgcaagactagagaaggaacaaaataagaaaaattcctcatcagaaaaattagatgagattaaatataaaataagtttagtagaaaataaaattgaagattataaattaaaaatagttgagttaaataaaattcttgaagaaacacaaaaagaaagaatggatatacagaaagaatttaaagaaaaatatgtagatgatctttatcaagttttagataaaataccctttaagcatttagacaataaaagtctagttactcaaagaataaaagctgatataaagtcagataaaagtaatggactattaaaaggtgaaagaagtattagaaactacaagagaaactttcctttaatgactagaggacgagatttaaaatttaaatatgatgataatgatgatattgaaataaagtggatggaaggaattaaatttaaagttattttgggaaatagaataaaaaattccttagagcttagacacactttacataaagttatagagggaaaatataaaatatgtgatagtagtttgcaatttgataaaaataataatcttatacttaatttaactctagacattcctattgatattgtaaataaaaaagtttcaggaagagttgtaggagtagatttaggattaaagataccagcatattgtgcattaaatgatgttgaatatattaaaaaatctataggacgtatagatgatttcttgaaagttagaactcaaatgcagagtagaagaagaagacttcaaattgcaatacaaagtgctaaaggtggaaaaggtagggtgaataaacttcaagccttggagagatttgctgaaaaggagaagaattttgcaaagacatataatcattttttaagttctaatatagttaaatttgcagttagcaatcaggccgaacaaattaatatggagttattaagtttaaaagaaactcaaaataagtcaatactaagaaattggagttattatcaacttcaaacaatgattgagtataaagcccaacgtgaagggattaaagttaagtacatagatccttatcatacatcacaaacatgtagtaaatgtggtaattatgaagaaggacaaagagaatctcaagctgattttatatgcaaaaaatgtggttataaagttaatgctgattataatgcagctagaaatatcgctatgagtaataaatatataacaaaaaaagaagaaagtaagtattacaaaattaaagaaagtatggtataa

SEQ ID NO: 32 - protein, 613 aa, Unknown
  Candidatus Micrarchaeota archaeon
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 33 - protein, 500 aa, Unknown
  Uncultured archaeon
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 34 - protein, 424 aa, Parageobacillus thermoglucosidasius
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVDLGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMEDLTGISKESTFLKNWTYYDLQQKIEYKAREAGIQVIKIEPQYTSQRCSKCGYIDKENRQEQATFKCIECGFKTNADYNAARNIAIPNIDKIIRKTLKMQ

SEQ ID NO: 35 - protein, 422 aa, Acidibacillus sulfuroxidans
MIKVYRYEIVKPLDLDWKEFGTILRQLQQETRFALNKATQLAWEWMGFSSDYKDNHGEYPKSKDILGYTNVHGYAYHTIKTKAYRLNSGNLSQTIKRATDRFKAYQKEILRGDMSIPSYKRDIPLDLIKENISVNRMNHGDYIASLSLLSNPAKQEMNVKRKISVIIIVRGAGKTIMDRILSGEYQVSASQIIHDDRKNKWYLNISYDFEPQTRVLDLNKIMGIDLGVAVAVYMAFQHTPARYKLEGGEIENFRRQVESRRISMLRQGKYAGGARGGHGRDKRIKPIEQLRDKIANFRDTTNHRYSRYIVDMAIKEGCGTIQMEDLTNIRDIGSRFLQNWTYYDLQQKIIYKAEEAGIKVIKIDPQYTSQRCSECGNIDSGNRIGQAIFKCRACGYEANADYNAARNIAIPNIDKIIAESIK

SEQ ID NO: 36 - protein, 440 aa, Ruminococcus sp.
MVKVVKIHLISEQFDKAGNRIDYEEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNEFYVRLALLKKAEFAKYGFKDGFRFKMQVKDNSTKTILERCFDEVYKINASKLLYDQKKKKWKLNLSYSFDNKNISELDKEKILGVDVGVNCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 37 - protein, 497 aa, Syntrophomonas palmitatica
MGESVKAIKLKILDMFLDPECTKQDDNWRKDLSTMSRFCAEAGNMCLRDLYNYFSMPKEDRISSKDLYNAMYHKTKLLHPELPGKVANQIVNHAKDVWKRNAKLIYRNQISMPTYKITTAPIRLQNNIYKLIKNKNKYIIDVQLYSKEYSKDSGKGTHRYFLVAVRDSSTRMIFDRIMSKDHIDSSKSYTQGQLQIKKDHQGKWYCIIPYTFPTHETVLDPDKVMGVDLGVAKAVYWAFNSSYKRGCIDGGEIEHFRKMIRARRVSIQNQIKHSGDARKGHGRKRALKPIETLSEKEKNFRDTINHRYANRIVEAAIKQGCGTIQIENLEGIADTTGSKFLKNWPYYDLQTKIVNKAKEHGITVVAINPQYTSQRCSMCGYIEKTNRSSQAVFECKQCGYGSRTICINCRHVQVSGDVCEECGGIVKKENVNADYNAAKNISTPYIDQIIMEKCLELGIPYRSITCKECGHIQASGNTCEVCGSTNILKPKKIRKAK

SEQ ID NO: 38 - protein, 497 aa, Clostridium novyi
MITVRKIKLTIMGDKDTRNSQYKWIRDEQYNQYRALNMGMTYLAVNDILYMNESGLEIRTIKDLKDCEKDIDKNKKEIEKLTARLEKEQNKKNSSSEKLDEIKYKISLVENKIEDYKLKIVELNKILEETQKERMDIQKEFKEKYVDDLYQVLDKIPFKHLDNKSLVTQRIKADIKSDKSNGLLKGERSIRNYKRNFPLMTRGRDLKFKYDDNDDIEIKWMEGIKFKVILGNRIKNSLELRHTLHKVIEGKYKICDSSLQFDKNNNLILNLTLDIPIDIVNKKVSGRVVGVDLGLKIPAYCALNDVEYIKKSIGRIDDFLKVRTQMQSRRRRLQIAIQSAKGGKGRVNKLQALERFAEKEKNFAKTYNHFLSSNIVKFAVSNQAEQINMELLSLKETQNKSILRNWSYYQLQTMIEYKAQREGIKVKYIDPYHTSQTCSKCGNYEEGQRESQADFICKKCGYKVNADYNAARNIAMSNKYITKKEESKYYKIKESMV

SEQ ID NO: 39 - DNA, 2815 bp, Unknown
  Candidatus Micrarchaeota archaeon
tgccaacatctggtctgcgcacgattttttctatttgttttttcactttttccttcaacagcttgtcccttattttcttgactttcttcttgaaaaaaaggtcgtatttgattgttaccattttttgagttcttccaggaattcctcgccgctgattccgttgacgccgcctttttcacatcttttaagcgcttcctcggcgcgctcggcaaaacgcaggtctttctccaggttctcgtcgaaagcggtcgcgctcttcaacacgaatttgtttccgcttcggattaccacgagcttgtctccctccttgaagccggcgcgcatttcgctgggaatcacgatttgcccttttgaactcattcggctgacaccaatgtctatcataaggtaagatgtgtcttacttactatatatttcttgtgttttggggtggcggcacgctaattaatttaaaaggcgtattgctttgcaggagttgctaaggagggttgcctgtggaaatgatttcactcaaacttaaactgcttccagacgaagaacaaaagaaattgcttgacgaaatgttttggaagtgggcctcgatttgtacccgcgttggttttgggcgggctgataaagaagatttaaaaccgccaaaagacgcggaaggggtttggtttagtttaacacaattaaatcaagccaacacagacattaacgacttaagggaggcgatgaagcaccaaaaacaccgcctagaatacgaaaaaaaccgtttggaagcgcaaagagatgatactcaggatgccttgaaaaatccggacagacgagaaataagcactaaaagaaaggatttattccgtcccaaagcgtccgtcgaaaaaggctttctgaaactgaagtatcatcaagagcgttattgggttcgaaggctgaaagaaataaacaaactaattgaaaggaaaacgaagacacttataaaaatagaaaaggggcgaatcaaattcaaggcaacgcgaataaccctgcaccaaggctcttttaaaattagattcggcgataaacccgcttttctgataaaggcgttgtctggaaaaaaccaaatagacgctccttttgttgtagtgccagaacaaccaatctgcgggagcgttgtaaatagcaagaaatacttagatgaaattactactaatttcttggcttacagcgtaaatgcaatgcttttcggtttgagccgcagcgaggaaatgttgttgaaagccaaaaggccagaaaaaatcaagaaaaaagaagaaaaacttgctaaaaaacaatcagcctttgaaaacaaaaagaaggaattgcaaaaattacttggtagagaactaacccagcaggaagaagcgattattgaagaaacccgcaaccaattctttcaagattttgaggtgaaaataaccaaacaatactcggaattactcagcaaaattgctaacgaactcaagcaaaaaaatgattttctgaaagtaaacaaatatcctatacttttaaggaaacctctcaagaaagccaaatcgaaaaaaattaataatctttcgccaagcgaatggaaatattacctccaattcggagttaaacctttactaaaacaaaaatcaagacgaaaatcaaggaatgttttgggaatagaccgcggccttaaacacttgctagccgtaaccgttcttgaacccgacaaaaaaacgtttgtatggaacaaactttacccaaacccaattacgggctggaagtggaggcgacgcaagcttttgcgctccttaaagcgattgaagaggcgcattaaatcgcaaaaacacgaaacaattcatgaaaaccaaacgaggaaaaagctcaagagtttacaaggcaggatagatgacctgcttcataatatttccagaaaaatagtggagaccgcaaaagaatatgatgcggtaatagtagtggaagacctccaaagcatgcggcaacacggtcgttcaaaaggcaatcgtttgaaaacactgaattacgcgctaagccttttcgattacgcaaacgtgatgcaacttataaagtacaaggcgggtatagaaggaatccaaatatatgacgttaaaccagctggcacaagccaaaattgcgcgtattgccttttagcgcaaagggattcacacgaatacaaaagaagccaagaaaactccaaaataggtgtttgcttaaatcctaactgccaaaaccacaagaaacaaattgacgctgacctaaacgcggcaagagtaatagctagttgttacgccttaaaaattaatgattcccaaccatttggaacaaggaaaagatttaaaaaaagaacaacgaattaatttaacggtaacctgtggaattcagtttactttggcagtcctaaaagaaccgtgtataccaacggatatggaatcggtgtaaatcgaaccatcctttgggacgggtgctcttctatatggcgagcaccttaagaagactcgttgcaagtcttttgggctcataaaccattgtcgcgatggataacggcctgacttagtttcggttcaaaattggttggtctttttaaataaggctacaaaaaggcccttatccgattacgctttttatccgggcattttcctgcctttttaggcgaattccaacgattttttcggctgttgcacagtgctaattagagaaactaggaatgcaacaacaatgattatccgtataattcgttgactttgcgggttgcacagtgctaattagagaaactaggaatgcaacctgcccattccgtcgcactcttaaccattatttcagggttgcacag

SEQ ID NO: 40 - DNA, 3687 bp, Unknown
  Uncultured archaeon
gtcgagcaggcgcgcaacgtcacccggtttctccttgacagaaagcaggaataccggggattcacgagcaggtggtgagcatgatctactgggtgatttacgacatcagcgcaaacggggcgcgcagcagggtggcttccgcgtgcaagaactacggattcaagcgcatccagaagagcgcgtttctgggcaacatcaccaaaaacaaggcggacatgctcgccatccagtgcagggacatggtgaaggaggaaggcgactgcgtcttcatcatcccggcgtgcgaacagtgcttcaggggaaaggaggtactcggcacgcttgacgagacggctgcgcggaagctcgactacctgatagtgggggaagatggacgacagacagcatctcacggcggctgacctgctgaactactgctactgcccgcgcattgtctattacgtgcacgtgctgaagctggcgcaggccacgaccgcgaaggagctgaaagggagggagaagtacgatgatttcaagcgaaaatcaagaaggaacaagattgtacgacgtgaccattgaatcaaagaggcacggcctcatcaccaaggcggactgcatcatgtttgacagggagaagggcgaggcataccccattcagcataagtacagcttcaggccgaaggcgatatatcgcacctacatcattcaattgcttatggaggccctccttgtcgaggagcagttcaatgttttggtccctcatggcttcatcatcttcgagcgctccaaggagacagtaaaggttgatttgtcaaataagcagaaagttttatatgccgtggggcagataagaggaattattgggggagaaaagttcccgccgccgacggaatggaaaaagcggtgcgtggactgttactataacaagctgtgttgggggtaagatggaagtacaaaaaactgtgatgaagacactttctttgagaatattaagacctctgtactcacaagaaatagaaaaagagattaaagaagaaaaagaaagaagaaaacaagccggaggaactggagagcttgacgggggattttataaaaagcttgagaagaagcattcagagatgttcagctttgataggttaaacttattgttgaatcaattacaaagagaaattgctaaggtctacaatcatgccatcagtgaattgtatatagcgactatcgctcaaggtaacaagagcaacaaacattatattagtagtattgtctataatcgagcatatggatacttttataacgcttacatagccttagggatatgttcaaaagttgaagcaaattttagatccaatgaactcctaacacaacaaagcgcattgcctacagcaaagtcagataattttccaatagttttacataaacaaaaaggtgctgagggagaggatggaggatttaggatatctactgaggggagcgatctgatatttgagatacccattccgttctatgaatataatggggagaaccgaaaagaaccctataaatgggttaaaaaaggaggacaaaaacctgtgttaaaacttatactttctacttttaggagacaaagaaataaggggtgggcaaaagacgagggcacggatgcggaaataagaaaggttacagaagggaagtatcaagtcagccaaatagaaataaataggggtaaaaaactaggagaacatcaaaaatggtttgccaatttcagcatagagcaaccaatttatgaaagaaaacctaatcggagtattgtcggcggattagacgtgggaataagatcccccctagtatgtgcaattaacaactcattttcgagatattctgttgattccaatgatgtatttaagttttctaaacaagtattcgcatttagaagacggctattatcgaaaaactctttgaaaaggaaaggtcatggggcggctcataagttagaacctatcacggaaatgacagaaaaaaatgacaagtttagaaagaaaataattgagagatgggccaaggaagttacaaatttctttgttaaaaaccaagtaggaattgttcagatagaagatttatcaacgatgaaagacagagaggatcatttttttaatcaatatcttagaggattttggccttattaccaaatgcagacattaattgagaacaagctcaaagagtatgggattgaggtaaaaagggtacaggcaaaatatacgtctcagttgtgctcaaaccctaattgcaggtattggaataactattttaactttgaataccgaaaagtaaataaattcccaaaatttaaatgtgaaaagtgtaacttagaaataagtgctgactataacgctgctcgcaatctatcaactcccgatatagagaaatttgtggcaaaagctacaaaaggcattaatttgccagaaaaatgagaatgttattccataataacatttgatgcacacgattcctccctacagtagttaggtatagccgaaaggtagagactaaatctgtagttggagtgggccgcttgcatcggcctaaagttgagaagtgtcagactctgataaccctcaacgacgatattctttatttcggttcaaagttctgcacaaaacaggtgagtccttataaaccggtgtgcagaacgccggctcacctttttccttcatccgattttacgcttaaaagccgtaaaaacgcggaattcggcgccgttgcagaacccgaatagacgaatgaaggaatgcaacaaaataatacaagcgtgtctttgttaaaacaatccacagttgcagaacccgaatagacgaatgaaggaatgcaacctcgatttacacgacatctcgtctgagtatgacggttgcagaacccgaatagacgaatgaaggaatgcaacctgtgtaagtgcgttagacatcgataacgtctgtaatgttgcagaacccgaatagacgaatgaaggaatgcaactttatcttttacatgaatcgcgtaatcttaacctggttgcagaacccgaatagacgaatgaaggaatgcaactgaagtccccctctgcactcacgtaaaaattattgttgcagaacccgaatagacgaatgaaggaatgcaactgtagcagtactgctcgggtcgctcagctaatgcgatgttgcagaacccgaatagacgaatgaaggaatgcaacagcctcgaaaggtatataaacctagccgactatcgggcatccatgaagcaagacatgatttccatatcgcggaaagagtacgagggcatgaaggaaaccatagagatgctgcaaagcccggagatgatgaggcagattctggagagcgagaagaacatctcagaaggcaaaataaaaaaatttgatgtctaatatacgttatgggttccgacggcctctacaacaattcttcggtttgaatcgtcaatgctgtacaccattcttatgcttgagccgagccagcagctccatttgcccgccaatctcccatgcagaggatgagcgccaatttcagtcctcggcgactgctttagtttatgaagcttgccgacaatgtcctgcctgccttttacataacgtgcaagcaatttttccgccttgctgtttgccgtatagatttcatacataggtggattgaatgatgaaactcatatataaacaatgccctccaacgagaatag

SEQ ID NO: 41 - DNA, 2929 bp, Parageobacillus thermoglucosidasius
tcaagcaattatcgtatagtctctgtcgtttggcagggctttttttattttcgtggaatgaaatattaggaggtgatatcgtgtttgagatcgtaggccgactgcgctgtcccatttgttcagaggtggttcgaccagacgagaaggtcttccttgacattatcaacaccatcatccatcagaagtgctactatcaatccccacgtagactcccgatcaaagacaaaggcccattccagaaaatgttcatgaaatatccattcttcaacgaggatgaggaagatgattccatatgaaaagcccttctcatcgagaggggcttgtttattttattgcatagttttttgcaaaatgaataaaaaatcatgtgacaacttacgtaaaccaaagacaaaaatgttccacgttagtaaaaagtattaaatggaaatttaatgtcaaaaatggaggtggtattgtttcaaaagtaacacttgttgtaaaaaaggggttgttaattgatgaagtatacgaaagtaatgaggtatcaaattatcaaacccttaaacgcagaatgggatgaattgggaatggttctccgtgacatccagaaagaaactcgcgcggcattaaacaagacgattcaattgtgttgggaatatcaaggatttagtgcggattataagcagatacacggtcagtatcctaaaccaaaagatgttttaggatacacaagtatgcacggatatgcttatgatcgtctcaaaaatgaattcagcaaaattgcaagttcaaacctttcgcaaactatcaaacgagcggtagataaatggaatagtgacttaaaagaaattctgcgtggtgaccgctccatccctaacttcagaaaagattgtccaattgatatcgttaagcaatcgacgaaaatacaaaaatgtaatgatggatacgtattaagcctcggtttaattaatagagagtataaaaatgaattgggacggaaaaacggagtatttgatgtacttataaaagcaaacgataaaacccagcaaaccatattagaacgaattataaatggcgattatacatatacggcatctcaaataatcaatcataaaaataagtggtttattaaccttacctatcaatttgaaactaaagaaacagccttagatcccaataatgtcatgggagttgatctaggaattgtttatcctgtttatatagcatttaataacagtcttcaccgttatcatattaaaggaggagaaatagaacgattcagacggcaagtagaaaaaaggaagagggaattgttaaatcaaggcaaatattgtggagacgggcgtaaagggcatggttatgctacaagaacaaagtccattgaatcaattagcgataaaattgcgagatttcgtgacacttgcaatcataaatattccaggtttattgtagatatggcgcttaaacataattgtgggataattcaaatggaagatttgactggaattagcaaggaaagtacatttttgaaaaattggacatattacgatcttcagcagaaaatcgaatataaggcacgagaagcaggaatacaagttataaaaattgaaccccaatatacatctcaacgttgtagtaaatgtggctatattgataaagagaatcggcaagaacaagctacatttaagtgcatcgaatgtggttttaagacaaatgctgactataatgcagcaaggaatatcgcaataccgaacattgacaagataataaggaaaacgttaaaaatgcaataaaaaatcccttggggcgattcagcgtccttaagtcgagaagtgccgtaataagcatctaaaaatgcctaacggtaacactcgataaggtagtcctgctaggcaggctgaaaccctagccacaaaatccggctaggcatcatacagaaaattgttgtcgaactataatcgtgcaaaaatcccaagggatcgacgacatttaaaatgttgatagctaagggatttacggttatttctaaaaaagaaaatctcttgagagagataagtgaaatgttgctttatcaatatcttttggggtttctgaagaaactatgtatgatgtgaagtattcgcgatcaaccaacgcgatcgtgtcggcaatttgagtttctgaagaaactatgtatgatgtgaaggtaaaaattggcgaggacgaattagatgacacagagtttctgaagaaactatgtatgatgtgaagcatttgaaagagctatgcaaatacttcgatcaaaaggtttctgaagaaactatgtatgatgtgaagtcgctcattcctctccctctctttcttcatgaagtaggtttcgaagaaactatgtatgatgtgaagttatcgtattgacacagtttgttccccacttggccgtttctgaagaaactatgtatgatgtgaagtttgttcgatggaaagtacgaagatgggaaagtagtttcaaaaagcccttctcgtatgagaaggggggattgaaggatattgtatgccgacaatcttgccgacattctgccgaccaaattttttgttcatgtaattttttatggttcataatgactttagaatgttgtaaaatcgaccattttgaaatgaactaattcccgatttcacctactcccccaccttgacagggtggaggtcgctggttcgagcccagtcggaatcactaaaatgtgaggcttgaaatccttgcgtatcaagggtttcaagctttttgttttttatagcaggcactcaaaatagcgtccaaattacggttggtgccattttggtgccgaagcatttttagtttgattttgataacaggacatcgatttgattagccgcttcctcttgcatattaggtaatacatgagaataaatgtctagtgttgttttaatattactgtggcctagacgttcg

SEQ ID NO: 42 - DNA, 3530 bp, Acidibacillus sulfuroxidans
acctgcataaggttgagaacctttcttatgcgaaaatcgcagaacttttgggcgtaaaaaaagggagcattgagcgatatatagagatggcccgtaagaaactggagcggccatcagcgcaactcgaaatggaaaacctttcttacgaaaagattgtgcaagatttgggcgaaaagagaaatgtaccgcgagcaatagatactacgagtgagaaggaatactcttcggtgcaacttgagtttgattttgaatgattactggttcatatttatattttctcggctcctttatctttgggagccgtatgttatttttgagtgttaatatttagattgaatactttttgttgtaaaaagaactggtgtctgatacgataaaagaaacttgtgaaataaactagtgcatatcatggctcgaaaacttgaaattgtgttaattctatggtgtaaattctaattagcatcacaatgtagtgttttgtttagacggaggcgagtggaatgatcaaagtatatcggtatgagatcgtaaaaccgcttgatttagattggaaagagtttggaactattttacgacagttacaacaggaaactcgttttgccttaaacaaagcgactcaactggcttgggaatggatgggctttagtagtgattataaggataatcatggggaatatccaaaaagtaaagacattctcggatacacgaatgttcacggatacgcttaccatacgatcaaaaccaaagcatatcgcttaaacagtggtaatttatctcaaaccatcaaacgtgcgacggatcgttttaaagcatatcaaaaggaaatcttacgtggcgatatgtccattccgtcctataaacgagatattccactcgatctgattaaagagaatatcagcgtaaatcgtatgaatcacggggattatatcgcttcgttatctctgttaagcaatccagccaagcaagaaatgaatgtaaagaggaaaatttcggtcataatcattgtccgtggcgcagggaaaacaatcatggacagaatcctaagtggtgaataccaagtctctgcttcacaaataattcacgatgatcgaaaaaacaaatggtatttaaacataagttatgattttgaaccccaaacccgagtgttggatctaaataaaataatggggattgatttaggcgttgctgttgccgtttacatggcatttcaacatacccctgctcgatacaaattggagggaggtgagattgaaaattttcgtagacaggtagaatctcgacggattagtatgttacgtcaaggtaaatatgccggtggtgcccgtggagggcatgggcgagataaaagaataaaaccgattgaacagcttcgagataaaattgctaattttagagataccacaaaccatcgttatagtagatatatagtggatatggcaattaaagaaggttgtggaacgattcagatggaggatttaacgaatatacgcgatattggatctcgatttttacaaaattggacctattatgatttgcagcaaaaaattatttataaagccgaagaggcaggaattaaagtcataaagatcgatccccaatataccagtcaacgttgtagtgaatgtggtaatatagattccgggaatcgaattggacaagctatctttaaatgcagagcttgcggatacgaagccaatgcagactacaatgctgcacgaaacatagcaataccgaacattgacaaaattatagctgagagtatcaaataaaaatctttcccaaatacttctattcgtcggttcagcgacgataagccgagaagtgccaataaaactgttaagtggtttggtaacgctcggtaaggtagccaaaaggctgaaactccgtgcacaaagaccgcacggacgcttcacatatagctcataaacaaatgtcgtcgacctctaatagcgtaaaaacctccggggatcgacgacagcaaaatgcaatatagtcgggcttttcaaaaaaacgccggtataaaccgacgaagcgcgaacgctgattttttgcggaagaaacgggtttgcgagctagcttgtggagtgtgaaccgagatgctgtagttgatgattatcttcaagatgctaggcgtttgcgagctagcttgtggagtgtgaaccagggtcggaacgaatcgggtacggtagcgggctatccgtttgcgagctagcttgtggagtgtgaactccgcctgcctgtcttactacctccacagggttgccgtgtttgcgagctagcttgtggagtgtgaactatacttatactaggataccctaaaatcgagcagaagtttgcgagctagcttgtggagtgtgaaccttcgataaaccgtatattggacttttttggagtttcgtttgcgagctagcttgtggagtgtgaactgatgattgtgaaggagattttgaagatcgaaccagtttgcgagctagcttgtggagtgtgaacaccaatcgctcaatctcgtcatcacaattagcaaaaagtttgcgagctagcttgtggagtgtgaactacagtagaagcaacacaattccaacccaattccatagtttgcgagctagcttgtggagtgtgaaccaggtacgaatatgtagaacgaaaaggtggaatggatgtttgcgagctagcttgtggagtgtgaacaattcgttaatcgtctatctcaaaaactagtaaataagtttgcgagctagcttgtggagtgtgaactgtcaacgtccccaatatacatttctggcctttttctagtttgcgagctagcttgtggagtgtgaacataagctaaggtataaatcgcaaacggaatggacagggtttgcgagctagcttgtggagtgtgaactcttccactggctattcttctatttcttctgctgaggtttgcgagctagcttgtggagtgtgaactgtatcaatatctttcccaaaaagctacggtcgatcgtttgcgagctagcttgtggagtgtgaaccctcttcctctctctgctgccgcactttagcctgcggtttgcgagctagcttgtggagtgtgaactcttccactggctattcatctatctcttctgttgaggtttgcgagctagcttgtggagtgtgaactgtatcaatatctttcccaaaaagctacggtcgatcgtttgcgagctagcttgtggagtgtgaactggaaatggtagtgatggggcgttcgcgcctgcgccgagtttgcgagctagcttgtggagtgtgaacttaccctatgcacatctggtattaagtcaatagatcaccatgccgcctgagcggcaccagtagaaggatgaaaatgggcttgtgtcgaaatgacaccttagcggctggcgaaggtaggtcgttccaaactggtgccatgagcccgctcaatagactgactacgacgacccagtgcaccatagtatgttgctccctttagggaagcacgcaggatagaatgatctttatggtcgttgcaccagcccttcaat

SEQ ID NO: 43 - DNA, 2702 bp, Ruminococcus sp.
ttgtcacaaagatcacgaagcaattaccattctgacctagctgccgtgcgacttcaaaaccggtcatttcaggcatatcaaggtcaagaaatatagccgaaaaaggctttttaccatggcagtaaaaaaagctctcagctttggtaaacgtttctatttcagccttgaccgaccttgattcaagttcatttgccagcatagatttaaaaaactgaagaaaaacagcattatcatcacaaactgcgatccgcattttttcacgtccttttataacatagtctgtgtacgattttatattaccataattataccgtaaggtcaagccataaaaccagcaataagcacctagcgtcaagaattgtcatgttgtgccaaaatcgaggaactttgttccaaaaaccacacctcatatttgtcccttttgccaatttacaaaaatatacttatgtgttacaataatagagtaaagtatattgatcgtgtgaaatggggtgacattactggtcaaagtcgtaaaaatccatctaattagtgagcaatttgacaaagcaggcaaccggatagattatgaagaagtcaataaaatactgtgggaattgcaaaagcagacacgagaagcaaagaataaaactgttcagcttctttgggaatggaacaatttttcaagcgattatgttaaggcgagtggcatatatcctaaagcaaaagacatatttggctactcaagtgtgcatggacaagcaaacaaagaattaagaacaaaactcgctttaaattcaagtaatctttccactaccacaatggacgtatgtaaaaattttaatacatataaaaaagaggtatggaaaggcaaacgatcagttccttcgtacaaatcagaccaacctcttgatctgcacaaagactctataaagctgatatatgaaaacaacgaattttatgttaggctcgctttattaaaaaaagctgaatttgcaaagtatggttttaaagacggttttcgttttaaaatgcaggtgaaagataattctaccaaaactattcttgaacgctgttttgacgaagtatacaaaataaatgccagcaaacttttatatgaccaaaagaaaaagaagtggaagcttaatctgtcttatagtttcgacaataaaaacatttctgaacttgacaaagaaaagatccttggtgttgatgtaggcgttaactgtcctttagtcgcttcggttttcggcgatcgtgaccgattcataatcaagggcggcgaaattgaaaaattcagaaaaagcgtggaagctcgcagacgttcaatgctcgagcaaacaaaatactgcggtgacggaagaattggtcacggcagaaaaaaacgcactgagcctgccctaaatataggcgacaagatagcaagatttcgtgatacaacaaaccacaaatacagcagagctttgatagaatatgctgtaaaaaagggctgcggaactatccaaatggaaaagctgacgggtattacatctaaatctgatcgttttctaaaagactggacttattatgacctccagacaaagatagaaaacaaggcgaaagaagtagggataaatgtcgtctatatcgcccctaaatatacaagtcagagatgtagcaaatgcggatatatccacaaggataacagaccaaatcaggcgaaatttagatgtcttgaatgcgattttgaaagtaatgcagattataatgcaagtcagaatatcggaattaaaaacattgataagataatagaaaaagatttgcaaaagcaagaaagcgaagtccaagtgaacgaaaacaagtagaaggttcacacaatttcagggcgactcggcgtcctaaaatcgagaaagtgtacataagtttttaacaaaatacggtaaatactctcggtaaggttttaacgtgcacataataatccgtgcaacagggttacacttttgtgcaattttgcagttgcaacttacgcataggtgtaaaatacgaggtgaatgttactgttgttgtgttttcctcaaaagttgcaacttacgcataggtgtaaaatacgagatcagaagtcaggataatgttatccttgtccgtgttgcaacttacgcataggtgtaaaatacgaggtccagaaaatcgtctgacattatcgtttgttcgttgcaacttacgcataggtgtaaaatacgaagcactcaatttgcattgtgatacgatattgaattacaatcacatatttgtaaaacaacaaaagggctgtccacacagcccttttgttcttatctaacctatgccaagccccctaccccttaggctttttcatagtaagcgaaatacgctttttcttcaggtcaacgttaagtacccaaaccttaactacctccccgacctttacgacctcaagagggtgctttatatatctgtcgcacatctgagaaatatgtacaagtccgtcctcgtgaacaccgatatcaacgaacgctccgaagtctataacgtttctcactgtgcccataagctccatgcccggcttcaagtctttaagctccataatgtcgccgcttctcataagcggtggaggcagctcgtcacgagggtcacgaccaggcttttcaagctcccctactatgtcctttaacgtcggtgcaccaatgccaatatctgtggcaagcttcttcatgcccattgcattg

SEQ ID NO: 44 - DNA, 5157 bp, Syntrophomonas palmitatica
gcaattgctataccaaaaaatactgcaaccggaaaataaaatttatccaggatgcagccctggataaaaaggaatatagttttatttctctgtttttatccttcttttgtagaaggatttttctgtctttaatattatcgtttagttcatctgttgttatcagcataagttcccaaagaacgtgcgcataatcatcagtagtggtactaactgacctgccccacaaattcttgaataattttttgatttacgtccaattccagtagccgcataacaaaagtgtgcctcaagccatgtaaattaaattctttgatacctgccttatccttaacccgataaaaaactcggttaaaattacgtggctcgtacagctaagatgcaactaataaatccctatacctaaccggagtctggtggcagatcagttataagtcaaaccccttttttgacacaatatgtttgttagtatataatttgacattgagaggggtattctgttgatgggcgaatcggtaaaagcaataaaattaaagatactggatatgtttttagaccccgaatgcacaaagcaggatgataactggcgcaaagatttgtctactatgtccagattctgcgctgaagcggggaatatgtgtctgcgcgacctgtataattacttttcaatgcccaaggaagaccgtatttcctcaaaagacttatataacgctatgtatcataaaactaaacttctccatcctgaattaccaggtaaggtagcgaaccaaatagtaaaccacgctaaagatgtttggaaacgcaacgctaaactcatttatcggaaccaaatctcaatgcctacatataagataacaacagcaccaatccggctgcaaaataacatttataaattaataaaaaataagaacaaatacataatagacgtacagttatactccaaggaatactccaaggatagtggtaaaggcactcataggtattttctggtagcagttagagactcatcaacccgtatgatattcgaccgtattatgagtaaggaccatattgacagtagtaaatcatacacgcaaggacaactccaaatcaagaaagaccaccaggggaaatggtattgcatcataccctatacattccctacacatgagacagtcctcgaccctgataaagtcatgggagtagaccttggcgttgcaaaagctgtttactgggcgtttaatagttcttataaaagaggctgtatcgacggtggggaaatagaacatttccgcaaaatgatacgagctcgcagggtgtccatccaaaatcaaatcaaacattcaggggacgcccgtaaaggacatgggcgcaaaagggcgttaaaacccatagaaacattgagcgagaaggaaaagaattttagggatacaataaaccaccgctatgcaaatcgaattgtagaagctgctattaagcaaggctgtgggacaatccaaatcgaaaaccttgaaggtatagctgacacaacaggcagtaaatttctcaagaactggccttattacgacctgcagacaaaaattgttaataaagccaaggaacatggcattaccgttgttgcaataaacccccaatatacatcccaaaggtgttcgatgtgcgggtatattgaaaaaaccaaccgttcatcacaggcagtatttgaatgtaaacaatgcggttacggcagtaggactatatgtattaactgcaggcacgtccaagtatccggggatgtttgtgaggaatgtggcggcatagtaaaaaaagaaaacgtaaacgcagactacaatgcggcaaaaaacatatccacaccgtacatcgaccagataataatggagaagtgtttagaactaggtattccttaccgcagtataacctgtaaagaatgtggtcacatacaggcttcaggaaatacctgcgaggtttgcggaagtactaatattttgaaaccaaagaaaattagaaaagcaaaataatcgcgaaccccaagttataaaaaaggtctttgacaacaaaacaagtcatatcgctttaaagcctgacataatttactctgtttcgcgcgccagggcagttaggtgccctaaaagagcgaagtggccgaaaggaaaggctaacgcttctctaacgctacggcgaccttggcgaaatgccatcaataccacgcggcccgaaagggttcgcgcgaaactgagtaataaaacattgcggatgcggcaatacagaaccgctgtcgcatcttgcgtaagcgcgtggattgaaactgtagtatttgcgggttgagattggcgggaattagtcgcatcttgcgtaagcgcgtggattgaaaccggttcgcacaggcagttttagcattggtgtggtgtcgcatcttgcgtaagcgcgtggattgaaacaacaacccgttcccacggtgcaccacaatgagggtcgcatcttgcgtaagcgcgtggattgaaacttaaatctatgtcaactgttgccagtattgtcaccgtcgcatcttgcgtaagcgcgtggattgaaaccaaactgaagatcgaatgttgcatcagctccagcgtgtcgcatcttgcgtaagcgcgtggattgaaacacaaatttcatttacttccatcccaatttttacagtcgcatcttgcgtaagcgcgtggattgaaactttgtcgttttaacctgtatgtcgtatgcattttgtcgcatcttgcgtaagcgcgtggattgaaactagtctgttttctaggtcattgattttgtcaagcgtcgcatcttgcgtaagcgcgtggattgaaaccgaaggagggttaatcgtttgattcttaaagaacgtcgcatcttgcgtaagcgcgtggattgaaacatgtttgaaggtattgttcaacaccctacacaaaagtcgcatcttgcgtaagcgcgtggattgaaactgtccagcaaggcaagtgcagtaaagaccgttagtcgcatcttgcgtaagcgcgtggattgaaacaaaacgatattcagacccaacagcaaaccctagcgtcgcatcttgcgtaagcgcgtggattgaaacttgatcggtaattgcgccatgccttattttatcggtcgcatcttgcgtaagcgcgtggattgaaacctcaaacttaaaacccctacatgtcatatctttgtcgcatcttgcgtaagcgcgtggattgaaacaacaaagtggaaggatttcccggagcagatattagtcgcatcttgcgtaagcgcgtggattgaaacatgcttgttgaacggtgcaaacacaccttcaatggtcgcatcttgcgtaagcgcgtggattgaaaccgcttatttgcttgctgatgaacaagttgcagacgtcgcatcttgcgtaagcgcgtggattgaaacttgaccacatccaacaatggtcattgcatcagggtcgcatcttgcgtaagcgcgtggattgaaacatttatgccggcaattatggaatttatgatgtagtcgcatcttgcgtaagcgcgtggattgaaactggtagtttattgatgtcaagttctgtccatctcgtcgcatcttgcgtaagcgcgtggattgaaacatacaccctaccctaaaaaacaacacacaataagcgtcgcatcttgcgtaagcgcgtggattgaaacttctctgtcgaaatttttgtttatttactggtttgtcgcatcttgcgtaagcgcgtggattgaaacatattgccttgctgacatataagcgtcataagccgtcgcatcttgcgtaagcgcgtggattgaaactgaagcctggggttatgggttttcgtccgtcatgtcgcatcttgcgtaagcgcgtggattgaaaccaagagcaacctcaaccaaacaccgccgatatttcgtcgcatcttgcgtaagcgcgtggattgaaacttttttattgccctttttaggttggcattgtctacgtcgcatcttgcgtaagcgcgtggattgaaacattttaaatggtttacttgttaaggcaattcgttgtcgcatcttgcgtaagcgcgtggattgaaactgatgcccccaatccatattggggtggaatattcagtcgcatcttgcgtaagcgcgtggattgaaacggtttgcaagtatatgccgtactgttgttctaatgtcgcatcttgcgtaagcgcgtggattgaaactcaaaatttgaagcgtggcttgatttacttttgcgtcgcatcttgcgtaagcgcgtggattgaaactgtaataatgggaataaaaagccgcccacattgtcgcatcttgcgtaagcgcgtggattgaaacaaccgggcagacgaagaaatcaccgaagaagaaagtcgcatcttgcgtaagcgcgtggattgaaacttccatcagtccatgacgaacggctagggagcctgtcgcatcttgcgtaagcgcgtggattgaaacatggcatcgttttcgttatcaaccaatatcttcgtcgcatctcgcgtaggcgcgtggattgaaactaatgatgtgcgattgacgtattgtctggcaacgtgtcgcatcttgcgtaagcgcgtggattgaaacccatttaaccttatacagagcattattacacaagtcgcatcttgcgtaagcgcgtggattgaaacagtaatcgaaaaagtgagctttgagtcggataacacatattggaccatatagtctcgaaggatctcatgaaattaataacggcttgtatgcaaggaacaataataaaaaaacaataaaacttagcaccgccaggatttcgtttttagcaattttaaatttataatggtaatcgttttcgctggacacttcgagtcgcgtttgtatttcatcggtatgctgcaaagaattggcgataaatgcagccagaatgttggacaattcttttagtttggatttaaaaccaagatcgttattcttaaaaacctgccgtacctgctccaaaatatcctgtttgaattgacttacagaccgggtcaattcgttcactataacccttgccatatgcaaatgttttgccaccggaatacccagtgaatttaagggagaaaggaccttgctcagcatttctgtgatgggctgaataggagtagtgaaaaaatacaagctgccgatataccag

SEQ ID NO: 45 - DNA, 3588 bp, Clostridium novyi
tacaagtccactttatgaaaaataagtaaaaaaatcaacataatatttattgaatagattatgaatttaattaaagaataatctattctttgttcaataaaatcatcagggattattcttagatacgtgaaatttataattttaacaagttgcatgtataatctgaacaataatattaagggaagtggttaatttggcaaatataaaatatgaaattacaaaatatccataatggaaaaaccaccataagggatattttgtagtctttaatgggctaaaggcctaaagttgaagtacaagaaaatcatattctacttcaactagaatattaacaaggataaaatggacttgcttaacatctgaaagaaaaacatttcagatataaagcaggtccattttttataaaatttaattataatacaatatatttgacgttaaatatgttaaaatagtaaataattataagagaatttaaggttgaatataaaggggagaaacttatgattacagttagaaaaataaagttaacaataatgggagataaagatacaagaaatagtcaatacaaatggattagagatgaacaatacaatcagtacagagctttaaatatgggtatgacttatttagctgtaaatgatattttatatatgaatgaaagcggattagaaattcgaactattaaagatttaaaagattgtgaaaaagatattgataaaaataaaaaagaaattgaaaagttaactgcaagactagagaaggaacaaaataagaaaaattcctcatcagaaaaattagatgagattaaatataaaataagtttagtagaaaataaaattgaagattataaattaaaaatagttgagttaaataaaattcttgaagaaacacaaaaagaaagaatggatatacagaaagaatttaaagaaaaatatgtagatgatctttatcaagttttagataaaataccctttaagcatttagacaataaaagtctagttactcaaagaataaaagctgatataaagtcagataaaagtaatggactattaaaaggtgaaagaagtattagaaactacaagagaaactttcctttaatgactagaggacgagatttaaaatttaaatatgatgataatgatgatattgaaataaagtggatggaaggaattaaatttaaagttattttgggaaatagaataaaaaattccttagagcttagacacactttacataaagttatagagggaaaatataaaatatgtgatagtagtttgcaatttgataaaaataataatcttatacttaatttaactctagacattcctattgatattgtaaataaaaaagtttcaggaagagttgtaggagtagatttaggattaaagataccagcatattgtgcattaaatgatgttgaatatattaaaaaatctataggacgtatagatgatttcttgaaagttagaactcaaatgcagagtagaagaagaagacttcaaattgcaatacaaagtgctaaaggtggaaaaggtagggtgaataaacttcaagccttggagagatttgctgaaaaggagaagaattttgcaaagacatataatcattttttaagttctaatatagttaaatttgcagttagcaatcaggccgaacaaattaatatggagttattaagtttaaaagaaactcaaaataagtcaatactaagaaattggagttattatcaacttcaaacaatgattgagtataaagcccaacgtgaagggattaaagttaagtacatagatccttatcatacatcacaaacatgtagtaaatgtggtaattatgaagaaggacaaagagaatctcaagctgattttatatgcaaaaaatgtggttataaagttaatgctgattataatgcagctagaaatatcgctatgagtaataaatatataacaaaaaaagaagaaagtaagtattacaaaattaaagaaagtatggtataataaaacatagttaaactaataaaaacagggcgatttaacgtcctaaggctgagagaagttttttctactcggcaagggttaatctcgattgttgtgttaccgatcgagcgtttcacaaaatgcgagagaaatctcgcatttttaattttgcagtaaggctagtttttatataaatatgctataaccattgatattgctaggctacaataggttttattaaaaaagcaaaaaacattactgaaggttcactgcaaaatagtgtatttaagtgaaagtgagattgcttgtaaagctaggagtatcaatatatttataaatttcaaaatttagggttttagtttaactatgtgaaatgtaaatatgtaataaatataaataataaatataaataactatgttttagtttaactatgtgaaatgtaaataattagatggtgttttaatctccatttattcggttctgttttagtttaactatgtgaaatgtaaatgaatgaaatatataataaaatagtaaaataaaatataagttttagtttaactatgtgaaatgtaaatatgtccattacttctataactgttgaggttggctatctgttttagtttaactatgtgaaatgtaaattttagtacttgctgtccagctacaaatccagtagcatgttttagtttaactatgtgaaatgtaaataatgtttcagcttgtacttttttagcgtttaaaattaagttttagtttaactatgtgaaatgtaaatatcccaatctaatttagaatcttgggactggtctacgtgttttagtttaactatgtgaaatgtaaattgggaacacgtttcatttacatttagtatagaaggaggttttagtttaactatgtgaaatgtaaattagttagcccattcacctcttgctttctttgcagcaataccgttttagtttaactatgtgaaatgtaaatctttcggttcttgtattttaattatgttatcttttttctgttttagtttaactatgtgaaatgtaaatcagatacagacttagaaaaagctccaacagaagaaggttttagtttaactatgtgaaatgtgaatgagcatagcaataaatttcgtttcattttgtttgagtaagttttagtaaaatactatgaagtgaagggatacgtattatgaaatttatcgaatcaatagatccttttttgatgcagttggttattgttccgctaatagtaattggattaggtgttttagtagcttataatattaaaaatatattaattggacctttaataacattgtttttaaatagtttatatgaaatttggtatataaaacactattgtcctggatcagaaattagtttgagttcttggaatattattcttccaatgatttcatttacaatttctttgattgtagtattaattagagaatagggtaatatttaataaagattatttcttaggctaggtgaaatgtaaataacctggattttctttagttgcaataatatcaatactaggttttagtttaactatgtgaaatagagaagcagaatataaaagctgaaactacaaactctccatcatgga

SEQ ID NO: 46 - DNA, 38 bp, Unknown
  Uncultured archaeon
gtttcagcgcacgaattaacgagatgagagatgcaact

SEQ ID NO: 47 - DNA, 37 bp, Unknown
  Candidatus Micrarchaeota archaeon
attgcagaacccaaagtaataggtcaaggaatgcaac

SEQ ID NO: 48 - DNA, 37 bp, Unknown
  Candidatus Aureabacteria bacterium
gttgcagatgtggagaaatagagataacgaatgcaac

SEQ ID NO: 49 - DNA, 37 bp, Unknown
  Uncultured archaeon
gttgcagaacccgaatagacgaatgaaggaatgcaac

SEQ ID NO: 50 - DNA, 37 bp, Unknown
  Candidatus Micrarchaeota archaeon
gttgcacagtgctaattagagaaactaggaatgcaac

SEQ ID NO: 51 - DNA, 37 bp, Unknown; identical to SEQ ID NO: 49
  Uncultured archaeon

SEQ ID NO: 52 - DNA, 30 bp, Parageobacillus thermoglucosidasius
gtttctgaagaaactatgtatgatgtgaag

SEQ ID NO: 53 - DNA, 29 bp, Acidibacillus sulfuroxidans
gtttgcgagctagcttgtggagtgtgaac

SEQ ID NO: 54 - DNA, 32 bp, Ruminococcus sp.
gttgcaacttacgcataggtgtaaaatacgag

SEQ ID NO: 55 - DNA, 32 bp, Syntrophomonas palmitatica
gtcgcatcttgcgtaagcgcgtggattgaaac

SEQ ID NO: 56 - DNA, 29 bp, Clostridium novyi
gttttagtttaactatgtgaaatgtaaat

SEQ ID NO: 57 - RNA, 58 nt, Artificial
  Cas-alpha 1 crRNA
  misc_feature (39)..(58): n is a, c, g, or u
guuucagcgcacgaauuaacgagaugagagaugcaacunnnnnnnnnnnnnnnnnnnn

SEQ ID NO: 58 - RNA, 57 nt, Artificial
  Cas-alpha 2 crRNA
  misc_feature (38)..(57): n is a, c, g, or u
auugcagaacccaaaguaauaggucaaggaaugcaacnnnnnnnnnnnnnnnnnnnn

SEQ ID NO: 59 - RNA, 57 nt, Artificial; identical to SEQ ID NO: 58
  Cas-alpha 4 crRNA
  misc_feature (38)..(57): n is a, c, g, or u

SEQ ID NO: 60 - RNA, 110 nt, Unknown
  Candidatus Micrarchaeota archaeon
uuuacuccgaguaaucggauguggauuauagcacagcaaccuauauggaagcugggaaccgguuuauccggaaaugcgcaccguugcauggaauuaugugcgcuuaagac

SEQ ID NO: 61 - RNA, 85 nt, Unknown
  Candidatus Micrarchaeota archaeon
uuauagcacagcaaccuauauggaagcugggaaccgguuuauccggaaaugcgcaccguugcauggaauuaugugcgcuuaagac

SEQ ID NO: 62 - RNA, 77 nt, Unknown
  Candidatus Micrarchaeota archaeon
cagcaaccuauauggaagcugggaaccgguuuauccggaaaugcgcaccguugcauggaauuaugugcgcuuaagac

SEQ ID NO: 63 - RNA, 69 nt, Unknown
  Candidatus Micrarchaeota archaeon
uauauggaagcugggaaccgguuuauccggaaaugcgcaccguugcauggaauuaugugcgcuuaagac

SEQ ID NO: 64 - RNA, 214 nt, Unknown
  Candidatus Micrarchaeota archaeon
aaaagauaaauauuaagaagcacauaauuuauuuugguuacauaucacuggauaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuugaaagguucuguaag

SEQ ID NO: 65 - RNA, 163 nt, Unknown
  Candidatus Micrarchaeota archaeon
auaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuugaaagguucuguaag

SEQ ID NO: 66 - RNA, 148 nt, Unknown
  Candidatus Micrarchaeota archaeon
auaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuu

SEQ ID NO: 67 - RNA, 127 nt, Unknown
  Candidatus Micrarchaeota archaeon
auuguauuaugcuccacuuuaauaaguggugccuuccaaagcuauaugcugagggaggaugggcgcuguugcagcgucugcccaccucagaguggguauccuuaccuauuuugaaagguucuguaag

SEQ ID NO: 68 - RNA, 161 nt, Unknown
  Uncultured archaeon
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaa

SEQ ID NO: 69 - RNA, 172 nt, Artificial
  Cas-alpha 1 sgRNA version 1
  misc_feature (153)..(172): n is a, c, g, or u
uuuacuccgaguaaucggauguggauuauagcacagcaaccuauauggaagcugggaaccgguuuauccggaaaugcgcaccguugcauggaauuaugugcgcuuaagacgaaaguuucagcgcacgaauuaacgagaugagagaugcaacunnnnnnnnnnnnnnnnnnnn

SEQ ID NO: 70 - RNA, 147 nt, Artificial
  Cas-alpha 1 sgRNA version 2
  misc_feature (128)..(147): n is a, c, g, or u
uuauagcacagcaaccuauauggaagcugggaaccgguuuauccggaaaugcgcaccguugcauggaauuaugugcgcuuaagacgaaaguuucagcgcacgaauuaacgagaugagagaugcaacunnnnnnnnnnnnnnnnnnnn

SEQ ID NO: 71 - RNA, 139 nt, Artificial
  Cas-alpha 1 sgRNA version 3
  misc_feature (120)..(139): n is a, c, g, or u
cagcaaccuauauggaagcugggaaccgguuuauccggaaaugcgcaccguugcauggaauuaugugcgcuuaagacgaaaguuucagcgcacgaauuaacgagaugagagaugcaacunnnnnnnnnnnnnnnnnnnn

SEQ ID NO: 72 - RNA, 131 nt, Artificial
  Cas-alpha 1 sgRNA version 4
  misc_feature (112)..(131): n is a, c, g, or u
uauauggaagcugggaaccgguuuauccggaaaugcgcaccguugcauggaauuaugugcgcuuaagacgaaaguuucagcgcacgaauuaacgagaugagagaugcaacunnnnnnnnnnnnnnnnnnnn

SEQ ID NO: 73 - RNA, 275 nt, Artificial
  Cas-alpha 2 sgRNA version 1
  misc_feature (256)..(275): n is a, c, g, or u
aaaagauaaauauuaagaagcacauaauuuauuuugguuacauaucacuggauaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuugaaagguucuguaaggaaaauugcagaacccaaaguaauaggucaaggaaugcaacnnnnnnnnnnnnnnnnnnnn

SEQ ID NO: 74 - RNA, 224 nt, Artificial
  Cas-alpha 2 sgRNA version 2
  misc_feature (205)..(224): n is a, c, g, or u
auaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuugaaagguucuguaaggaaaauugcagaacccaaaguaauaggucaaggaaugcaacnnnnnnnnnnnnnnnnnnnn

SEQ ID NO: 75 - RNA, 196 nt, Artificial
  Cas-alpha 2 sgRNA version 3
  misc_feature (177)..(196): n is a, c, g, or u
auaaugagaacagcuguagauuaagcuguuugauguauuguauuaugcuccacuuuaauaaguggugccuuccaaagcuauaugcugagggaggaugggcgcuguugcagcgucugcccaccucagaguggguauccuuaccuauuuugaaaaaguaauaggucaaggaaugcaacnnnnnnnnnnnnnnnnnnnn

SEQ ID NO: 76 - RNA, 188 nt, Artificial
  Cas-alpha 2 sgRNA version 4
  misc_feature (169)..(188): n is a, c, g, or u
auuguauuaugcuccacuuuaauaaguggugccuuccaaagcuauaugcugagggaggaugggcgcuguugcagcgucugcccaccucagaguggguauccuuaccuauuuugaaagguucuguaaggaaaauugcagaacccaaaguaauaggucaaggaaugcaacnnnnnnnnnnnnnnnnnnnn

SEQ ID NO: 77 - RNA, 222 nt, Artificial
  Cas-alpha 4 sgRNA version 1
  misc_feature (203)..(222): n is a, c, g, or u
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacnnnnnnnnnnnnnnnnnnnn

SEQ ID NO: 78 - DNA, 36 bp, Artificial
  T2 spacer
agttgacccaacgtcgccggcgtgcacaatctagat

SEQ ID NO: 79 - DNA, 5100 bp, Artificial
  Complete Cas-alpha 1 locus engineered to target T2
tcgcgtctatggcgtgattttgcagcttccctaaattcagccccttctcctcaaagcccagaagctcctttaatgcctgctcgtttgcgccctccacctttgagcccggggcggcggggaagatgctgcgcaccaatcttccttccttgtagactccaagcgccctaacccttgcgattacatactcccagtccgcagtcgggaaattctgcggcatcggggagcctttctcgtactctgaaacgctttccgcatgctcaaaatagcggtttgcgcgcattatctcggaaattgtgccaaaaagcattccatcctcgcagcgtgtctggacgaactgccccttccttacattcggggaggagattacgaaggagaagaaggaggtggtggggctgtctattgtggagatgaccgtgccaagggaggtggaatccatgaagaggttttgaggagaaaattaatatatggaattgaggggggtcggacttctaccctgtaagtgtttataaggagaactccatatatacttcggatatgcaactaataattgacgattatggcgcatatcttgggcagaaggacaacctcttccaaataaggaagaaagacgggacgtgtgaagaatattctgccgacaaggttgagcagatacttcttgtgaaaaatagctgtatttcttcaagagccgcactcttggcagcacgaaacaacatagatgtagtgtttgtaggaaaattcggaatgccggaaggaaggatttttcctgcatgtcttggaggaacaaatctcataagaagaaaacaacttgaagcagggcagaatgagaaaggagggaaaattgcaataaaacttatctgggcaaagatcaagaatgaggaatttttccttaaaactctcaacaaaagcagaactgcgcctcttcttttggagaaagcggaaaaaataagcgctattgcggagcaagtccggcagatgttaggcgagaaatttgatgcagatagggtttttggttttgaaggattggctgcggcgcactattttgagggattgtcacaggtaatgccgattgaaaagcgcgaccaagagggaaaagatgccccaaatgcactcttgaattatggttatggaatgttgtacggagagatagagaaagcctgcctttttgccggtttggacccgtatcttggctttcttcatgcagataggtacggcaagccctctcttgtacttgatttgatagaagagttcagaccggttattgttgatagggcgattattacgctttacgcacagaaacagataaacgagagtgattttgagcagggaggagataagatttttctttcaaaagaagggagaaagaagatgataaaggcaattatggaaagactgcatgcaaaaataacttcagatgggcgcaagcttgagctttcggtgataatacaggagcaggcgcgaagaatcgcctcctttgtgaagggagagagcgagtttgagccttttctttacaggtggtaggatgttttattgggtaatttatgatataagcgaaaacaagaaacgcggcagggtggcaagaatatgcaaaaactacgggtttagaagagtgcagaagagcgcctttgcaggcgaaacttcaaagaataaggtggagatgctgttattggaatgcaatgagattatagagggaggggatgattatttgtttgtcattccgaactgcacaagctgtttcaatgggaaaatgataaccggctgtcttgacgagaaaagagtgagaaatcagccgtatatgtttgtaggtgatggcgcatgaacagaatgggaattttgagcattcgagacatattgaattacaactactgcccgcgcatagtatattttgagtatgttctgcgcagaccacagggcaggacgaaaaaggaggatgagggattgaaacagcataatgaatttgtgccaagagggaagaggaataagatggttaaacggatttgttatgacaagaagctgtttaatctgccgctttattctccgcgcatgaaccttcaaactgtggcggattgcgtgcttattgacacaaaagagaagcttgctgttccgatgcagtttaagcatggaaaaacaccttcttgcttgtatcggactatgaaataccagcttgtagcggaggcgttgctgattgaggagtgccttgggctttcatgtccttatggacttgtgaaattcttacctgaagaaacaactcttagaacagaaatagacgaaattcaaaagcaaaaacttaaagaacagcttgagagtattaacaacgtggtgaggtttgaaaggtatcccgatggtccgagaacgaggaattactgcggggactgctggtatcatggaaaagtttgcacgggatttgacggcaaaatagtgggatgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctcaatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatgatttactccgagtaatcggatgtggattatagcacagcaacctatatggaagctgggaaccggtttatccggaaatgcgcaccgttgcatggaattatgtgcgcttaagaccttatgatatcgcgcggcttgacttcgcgatagacaggtcaactattgtctcggttcaacgtgccaattagcaggtctttataaatagcctgcagattttcaagttgcttttcttagtgcagaaaagaaggcaggagaagcctccgtttggcaaaaaaaggcggttgtatctactgtttcagcgcacgaattaacgagatgagagatgcaactagttgacccaacgtcgccggcgtgcacaatctagatgtttcagcgcacgaattaacgagatgagagatgcaactagttgacccaacgtcgccggcgtgcacaatctagatgtttcagcgcacgaattaacgagatgagagatgcaactagttgacccaacgtcgccggcgtgcacaatctagatgtttcagcgcacgaattaacgagatgagagatgcaactcagtagaagataaaacagaattagaataagatggcttccagcctgatggtcgtgctcataaccgaattgctgaagtatacgtgcaagctcccttccagaaatgacgggcagtttaggcatgtacctcaacaatttcttcccgtattgacggcggaaccggctccccgtgctttttcaggctcgcaagatagcccttgatggcgtctttaacgtttgcaagcgcatcttccctagttgttccctgcgaaacacagcccggaagcgaggtgcaaaccgcgacgtatgcaccgtcttcgtcttcttctacaatcaccctgaatttcataagtatctttgggctttttggagtttataagaatgatggatttgggaagttgcaccgcgcggattagtgggagccccgtcatttcggcgcatccaaaaggagtataagctccctcgtttttgcttcaaattccttttttcttcaattccgcaaatctgcctttgcgggagcttcg

SEQ ID NO: 80 - DNA, 2237 bp, Artificial
  Minimal Cas-alpha 1 locus engineered to target T2
atgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctcaatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatgatttactccgagtaatcggatgtggattatagcacagcaacctatatggaagctgggaaccggtttatccggaaatgcgcaccgttgcatggaattatgtgcgcttaagaccttatgatatcgcgcggcttgacttcgcgatagacaggtcaactattgtctcggttcaacgtgccaattagcaggtctttataaatagcctgcagattttcaagttgcttttcttagtgcagaaaagaaggcaggagaagcctccgtttggcaaaaaaaggcggttgtatctactgtttcagcgcacgaattaacgagatgagagatgcaactagttgacccaacgtcgccggcgtgcacaatctagatgtttcagcgcacgaattaacgagatgagagatgcaactagttgacccaacgtcgccggcgtgcacaatctagatgtttcagcgcacgaattaacgagatgagagatgcaactagttgacccaacgtcgccggcgtgcacaatctagatgtttcagcgcacgaattaacgagatgagagatgcaactcagtagaagataaaacagaattagaataagatggcttccagcctgatggtcgtgctc

SEQ ID NO: 81 - protein, 10 aa, Artificial
  10X His tag
HHHHHHHHHH

SEQ ID NO: 82 - protein, 6 aa, Artificial
  6X His tag
HHHHHH

SEQ ID NO: 83 - protein, 367 aa, Artificial
  maltose binding protein tag
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQT

SEQ ID NO: 84 - protein, 7 aa, Tobacco etch virus
ENLYFQS

SEQ ID NO: 85 - DNA, 31 bp, Artificial
  A1 oligonucleotide
cggcattcctgctgaaccgctcttccgatct

SEQ ID NO: 86 - DNA, 30 bp, Artificial
  A2 oligonucleotide
gatcggaagagcggttcagcaggaatgccg

SEQ ID NO: 87 - DNA, 22 bp, Artificial
  R0 oligonucleotide
gccagggttttcccagtcacga

SEQ ID NO: 88 - DNA, 28 bp, Artificial
  C0 oligonucleotide
gaaattctaaacgctaaagaggaagagg

SEQ ID NO: 89 - DNA, 56 bp, Artificial
  F1 oligonucleotide
ctacactctttccctacacgacgctcttccgatctaaggcggcattcctgctgaac

SEQ ID NO: 90 - DNA, 49 bp, Artificial
  R1 oligonucleotide
caagcagaagacggcatacgagctcttccgatctcggcgacgttgggtc

SEQ ID NO: 91 - DNA, 35 bp, Artificial
  Bridge amplification portion of F1 oligonucleotide
ctacactctttccctacacgacgctcttccgatct

SEQ ID NO: 92 - DNA, 34 bp, Artificial
  Bridge amplification portion of R1 oligonucleotide
caagcagaagacggcatacgagctcttccgatct

SEQ ID NO: 93 - DNA, 43 bp, Artificial
  F2 oligonucleotide
aatgatacggcgaccaccgagatctacactctttccctacacg

SEQ ID NO: 94 - DNA, 18 bp, Artificial
  R2 olignonucleotide
caagcagaagacggcata

SEQ ID NO: 95 - DNA, 60 bp, Artificial
  C1 oligonucleotide
ctacactctttccctacacgacgctcttccgatctggaataaacgctaaagaggaagagg

SEQ ID NO: 96 - DNA, 36 bp, Artificial
  Sequence resulting from cleavage and adapter ligation at position 21 of the target
ccgctcttccgatctgccggcgacgttgggtcaact

SEQ ID NO: 97 - DNA, 15 bp, Artificial
  Adapter portion of SEQ ID NO. 96
ccgctcttccgatct

SEQ ID NO: 98 - DNA, 21 bp, Artificial
  Target portion of SEQ ID NO. 96
gccggcgacgttgggtcaact

SEQ ID NO: 99 - DNA, 10 bp, Artificial
  Sequence 5' of PAM
tgtcctcttc

SEQ ID NO: 100 - DNA, 40 bp, Artificial
  Fixed double stranded DNA target
ttatagttgacccaacgtcgccggcgtgcacaatctagat

SEQ ID NO: 101 - DNA, 36 bp, Artificial; identical to SEQ ID NO: 78
  T2 target sequence

SEQ ID NO: 102 - RNA, 222 nt, Artificial
  Cas-alpha 4 T2-1 sgRNA
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacccggcgacguugggucaacu

SEQ ID NO: 103 - RNA, 222 nt, Artificial
  Cas-alpha 4 T2-2 sgRNA
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacaguugacccaacgucgccgg

SEQ ID NO: 104 - RNA, 57 nt, Artificial
  Cas-alpha 4 T2-1 crRNA
guugcagaacccgaauagacgaaugaaggaaugcaacccggcgacguugggucaacu

SEQ ID NO: 105 - RNA, 57 nt, Artificial
  Cas-alpha 4 T2-1 crRNA
guugcagaacccgaauagacgaaugaaggaaugcaacaguugacccaacgucgccgg

SEQ ID NO: 106 - DNA, 189 bp, Solanum tuberosum
gtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcag

SEQ ID NO: 107 - protein, 7 aa, Simian virus 40
PKKKRKV

SEQ ID NO: 108 - protein, 16 aa, Mus musculus
KRPAATKKAGQAKKKK

SEQ ID NO: 109 - DNA, 896 bp, Zea mays
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctt

SEQ ID NO: 110 - DNA, 278 bp, Gallus gallus
tcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcg

SEQ ID NO: 111 - DNA, 286 bp, Human beta herpesvirus 5
cgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatg

SEQ ID NO: 112 - DNA, 82 bp, Zea mays
tccccaacctcgtgttgttcggagcgcacacacacacaaccagatctcccccaaatccacccgtcggcacctccgcttcaag

SEQ ID NO: 113 - DNA, 1013 bp, Zea mays
gtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 114 - DNA, 228 bp, Artificial
  hybrid intron
ggagtcgctgcgcgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcag

SEQ ID NO: 115 - DNA, 1000 bp, Zea mays
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 116 - DNA, 249 bp, Homo sapiens
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 117 - protein, 8 aa, Artificial
  Strep II tag
WSHPQFEK

SEQ ID NO: 118 - DNA, 208 bp, Bos taurus
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctgggga

SEQ ID NO: 119 - DNA, 317 bp, Solanum tuberosum
agacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggc

SEQ ID NO: 120 - DNA, 113 bp, Zea mays
cctatagtacactagtaaggtgcatgtgctaacaatatgacaaatctagtatttctttatagtttatcatccataaatcgcaaaatacctaagcataattttatttgaataga

SEQ ID NO: 121 - DNA, 83 bp, Zea mays
cctatagtacactagtaaggtgcatgtgctaacaatacatccataaatcgcaaaatacctaagcataattttatttgaataga

SEQ ID NO: 122 - DNA, 104 bp, Zea mays
cctatagtacactagtaaggtgcatgtgctaacaatatgacaaatctggtatttctttatagtttaaatcgcaaaatacctaagcataattttatttgaataga

SEQ ID NO: 123 - DNA, 110 bp, Zea mays
cctatagtacactagtaaggtgcatgtgctaacaatatgacaaatctagtatttctttatagtttatccataaatcgcaaaatacctaagcataattttatttgaataga

SEQ ID NO: 124 - DNA, 110 bp, Zea mays
cctatagtacactagtaaggtgcatgtgctaacaatatgacaaatctagtatttcatagtttatcatccataaatcgcaaaatacctaagcataattttatttgaataga

SEQ ID NO: 125 - DNA, 110 bp, Zea mays; identical to SEQ ID NO: 123

SEQ ID NO: 126 - DNA, 113 bp, Homo sapiens
gggcaaagtgagtgacctgcttttgggggtgaccgccggagcgcggcgtgagccctcccccttgggatcccgcagctgaccagtcgcgctgacggacagacagacagacaccg

SEQ ID NO: 127 - DNA, 111 bp, Homo sapiens
gggcaaagtgagtgacctgcttttgggggtgaccgccggagcgcggcgtgccctcccccttgggatcccgcagctgaccagtcgcgctgacggacagacagacagacaccg

SEQ ID NO: 128 - DNA, 107 bp, Homo sapiens
gggcaaagtgagtgacctgcttttgggggtgaccgccggagcgcggccctcccccttgggatcccgcagctgaccagtcgcgctgacggacagacagacagacaccg

SEQ ID NO: 129 - DNA, 111 bp, Homo sapiens; identical to SEQ ID NO: 127

SEQ ID NO: 130 - DNA, 111 bp, Homo sapiens
gggcaaagtgagtgacctgcttttgggggtgaccgccggagcgcggcgagccctcccccttgggatcccgcagctgaccagtcgcgctgacggacagacagacagacaccg

SEQ ID NO: 131 - DNA, 112 bp, Homo sapiens
gggcaaagtgagtgacctgcttttgggggtgaccgccggagcgcggcgtagccctcccccttgggatcccgcagctgaccagtcgcgctgacggacagacagacagacaccg

SEQ ID NO: 132 - DNA, 113 bp, Homo sapiens
cccccaccccctttccaaagcccattccctctttagccagagccggggtgtgcagacggcagtcactagggggcgctcggccaccacagggaagctgggtgaatggagcgagc

SEQ ID NO: 133 - DNA, 111 bp, Homo sapiens
cccccaccccctttccaaagcccattccctctttagccagagccggggtgtgcagacgggtcactagggggcgctcggccaccacagggaagctgggtgaatggagcgagc

SEQ ID NO: 134 - DNA, 101 bp, Homo sapiens
cccccaccccctttccaaagcccattccctctttagccagagccgggcagtcactagggggcgctcggccaccacagggaagctgggtgaatggagcgagc

SEQ ID NO: 135 - DNA, 110 bp, Homo sapiens
cccccaccccctttccaaagcccattccctctttagccagagccggggtgtgcagacagtcactagggggcgctcggccaccacagggaagctgggtgaatggagcgagc

SEQ ID NO: 136 - DNA, 600 bp, Saccharomyces cerevisiae
gcgtattaccttctgctggattcaaacactcttctccagtaaaaagattcccttctcactctgcttagagaaggagtgccaggccggctaagcccactctccagacggaaaccatacaatgcctccgctggctgcattgtcgcgccccgcccaacgacggtttaccgacagctgctagctgggctcaacaggtggttagcccaccaattcccctgtcgctcttcgctctgaatgtgacggcaaatttcgacccgttgttcctgttccttttttttttcaattggactgaaaaaaaaaaagaaccgaatctggaaagatacacccaaacatacatagaatgtacggatgcatgattgtctcagcctcgtttggctcatcgttcttcatttctttttcctaattttgatagagacaatagatagacgtggaaggaaaaaaaaaaggaaagcccaacaatattgagaaacgaagaggtgtatttggtttaaatagagcctcttcattcctttcctgatctgacaacagggtggaacataaaatatagatctgtagtgagtgcgaatagcaatagtaagtgaacgaaaaaggaatacgataata

SEQ ID NO: 137 - DNA, 466 bp, Saccharomyces cerevisiae
tgaagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggattct

SEQ ID NO: 138 - DNA, 43 bp, Artificial
  HH Ribozyme (where N represents nucleotides that are complementary to the 6 nucleotides 3' of ribozyme)
  misc_feature (1)..(6): n is a, c, g, or t
nnnnnnctgatgagtccgtgaggacgaaacgagtaagctcgtc

SEQ ID NO: 139 - DNA, 68 bp, Hepatitis delta virus
ggccggcatggtcccagcctcctcgctggcgccggctgggcaacatgcttcggcatggcgaatgggac

SEQ ID NO: 140 - DNA, 269 bp, Saccharomyces cerevisiae
tctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatc

SEQ ID NO: 141 - DNA, 20 bp, Saccharomyces cerevisiae
tttttttgttttttatgtct

SEQ ID NO: 142 - DNA, 25 bp, Artificial
  5' to 3' top strand of target sequence Cas-alpha4 cleavage
ccaacgtcgccggcgtgcacaatct

SEQ ID NO: 143 - DNA, 25 bp, Artificial
  3' to 5' bottom strand of target sequence Cas-alpha4 cleavage
agattgtgcacgccggcgacgttgg

SEQ ID NO: 144 - DNA, 57 bp, Zea mays
ccacgacgggcgttccttgcgcagctgtgctcgacgttgtcactgaagcgggaaggg

SEQ ID NO: 145 - DNA, 46 bp, Zea mays
ccacgacgggcgttccttgcgcagctgtgcactgaagcgggaaggg

SEQ ID NO: 146 - DNA, 47 bp, Zea mays
ccacgacgggcgttccttgcgcagctgtgtcactgaagcgggaaggg

SEQ ID NO: 147 - DNA, 45 bp, Zea mays
ccacgacgggcgttccttgcgcagctgtggctgaagcgggaaggg

SEQ ID NO: 148 - DNA, 48 bp, Zea mays
ccacgacgggcgttccttgcgcagctgtgctcactgaagcgggaaggg

SEQ ID NO: 149 - DNA, 45 bp, Zea mays
ccacgacgggcgttccttgcgcagctgtgactgaagcgggaaggg

SEQ ID NO: 150 - DNA, 54 bp, Zea mays
ccacgacgggcgttccttgcgcagctgtgctcgatgtcactgaagcgggaaggg

SEQ ID NO: 151 - DNA, 45 bp, Zea mays
ccacgacgggcgttccttgcgcagctgtcactgaagcgggaaggg

SEQ ID NO: 152 - DNA, 43 bp, Zea mays
ccacgacgggcgttccttgcgcagctcactgaagcgggaaggg

SEQ ID NO: 153 - DNA, 41 bp, Zea mays
ccacgacgggcgttccttgcgcagcactgaagcgggaaggg

SEQ ID NO: 154 - DNA, 50 bp, Zea mays
ccacgacgggcgttccttgcgcagctgtgctgtcactgaagcgggaaggg

SEQ ID NO: 155 - DNA, 48 bp, Zea mays
ccacgacgggcgttccttgcgcagctgtggtcactgaagcgggaaggg

SEQ ID NO: 156 - DNA, 44 bp, Zea mays
ccacgacgggcgttccttgcgcagctgcactgaagcgggaaggg

SEQ ID NO: 157 - DNA, 49 bp, Zea mays
ccacgacgggcgttccttgcgcagctgtgctcgactgaagcgggaaggg

SEQ ID NO: 158 - DNA, 38 bp, Zea mays
ccacgacgggcgttccttgcgcagctgtgcgggaaggg

SEQ ID NO: 159 - DNA, 49 bp, Zea mays
ccacgacgggcgttccttgcgcagctgtgcttcactgaagcgggaaggg

SEQ ID NO: 160 - DNA, 47 bp, Zea mays
ccacgacgggcgttccttgcgcagctgtgacactgaagcgggaaggg

SEQ ID NO: 161 - DNA, 47 bp, Zea mays
ccacgacgggcgttccttgcgcagctgtgccactgaagcgggaaggg

SEQ ID NO: 162 - DNA, 45 bp, Zea mays
ccacgacgggcgttccttgcgcagctgtgcctgaagcgggaaggg

SEQ ID NO: 163 - DNA, 38 bp, Zea mays
ccacgacgggcgttccttgcgcagctgagcgggaaggg

SEQ ID NO: 164 - DNA, 84 bp, Zea mays
tccgcaacgcgtcgccgttcaagttcacggcgttccaggcggggccgaggatctgcctgggcaaggactcggcgtacctgcaga

SEQ ID NO: 165 - DNA, 75 bp, Zea mays
tccgcaacgcgtcgccgttcaagttcacggcgttcccgaggatctgcctgggcaaggactcggcgtacctgcaga

SEQ ID NO: 166 - DNA, 77 bp, Zea mays
tccgcaacgcgtcgccgttcaagttcacggcgttcggccgaggatctgcctgggcaaggactcggcgtacctgcaga

SEQ ID NO: 167 - DNA, 78 bp, Zea mays
tccgcaacgcgtcgccgttcaagttcacggcgttccagccgaggatctgcctgggcaaggactcggcgtacctgcaga

SEQ ID NO: 168 - DNA, 76 bp, Zea mays
tccgcaacgcgtcgccgttcaagttcacggcgttcgccgaggatctgcctgggcaaggactcggcgtacctgcaga

SEQ ID NO: 169 - DNA, 77 bp, Zea mays
tccgcaacgcgtcgccgttcaagttcacggcgttcagccgaggatctgcctgggcaaggactcggcgtacctgcaga

SEQ ID NO: 170 - DNA, 89 bp, Saccharomyces cerevisiae
agggtaaatttttaatttgggatgttttacttgaagattctttagtgtaggaacatcaacatgctcaatctcaatcgttagcacatcac

SEQ ID NO: 171 - DNA, 90 bp, Artificial
  Repair template
agggtaaatttttaatttgggatgttttacttcaagaatctttagtgtaggatcatcaaacatgctcaatctcaatcgttagcacatcac

SEQ ID NO: 172 - DNA, 90 bp, Saccharomyces cerevisiae
agggtaaatttttaatttgggatgttttacttgaagattctttagtgtaggatcatcaaacatgctcaatctcaatcgttagcacatcac

SEQ ID NO: 173 - DNA, 90 bp, Saccharomyces cerevisiae
agggtaaatttttaatttgggatgttttacttgaagattctttagtgtaggaacatcaaacatgctcaatctcaatcgttagcacatcac

SEQ ID NO: 174 - DNA, 90 bp, Saccharomyces cerevisiae; identical to SEQ ID NO: 172

SEQ ID NO: 175 - DNA, 90 bp, Saccharomyces cerevisiae; identical to SEQ ID NO: 172

SEQ ID NO: 176 - DNA, 90 bp, Saccharomyces cerevisiae; identical to SEQ ID NO: 173

SEQ ID NO: 177 - RNA, 57 nt, Artificial
  Cas-alpha 3 crRNA
  misc_feature (38)..(57): n is a, c, g, or u
guugcagauguggagaaauagagauaacgaaugcaacnnnnnnnnnnnnnnnnnnnn

SEQ ID NO: 178 - RNA, 57 nt, Artificial
  Cas-alpha 5 crRNA
  misc_feature (38)..(57): n is a, c, g, or u
guugcacagugcuaauuagagaaacuaggaaugcaacnnnnnnnnnnnnnnnnnnnn

SEQ ID NO: 179 - RNA, 57 nt, Artificial
  Cas-alpha 6 crRNA
  misc_feature (38)..(57): n is a, c, g, or u
guugcagaacccgaauagacgaaugaaggaaugcaacnnnnnnnnnnnnnnnnnnnn

SEQ ID NO: 180 - RNA, 50 nt, Artificial
  Cas-alpha 7 crRNA
  misc_feature (31)..(50): n is a, c, g, or u
guuucugaagaaacuauguaugaugugaagnnnnnnnnnnnnnnnnnnnn

SEQ ID NO: 181 - RNA, 49 nt, Artificial
  Cas-alpha 8 crRNA
  misc_feature (30)..(49): n is a, c, g, or u
guuugcgagcuagcuuguggagugugaacnnnnnnnnnnnnnnnnnnnn

SEQ ID NO: 182 - RNA, 52 nt, Artificial
  Cas-alpha 9 crRNA
  misc_feature (33)..(52): n is a, c, g, or u
guugcaacuuacgcauagguguaaaauacgagnnnnnnnnnnnnnnnnnnnn

SEQ ID NO: 183 - RNA, 52 nt, Artificial
  Cas-alpha 10 crRNA
  misc_feature (33)..(52): n is a, c, g, or u
gucgcaucuugcguaagcgcguggauugaaacnnnnnnnnnnnnnnnnnnnn

SEQ ID NO: 184 - RNA, 49 nt, Artificial
  Cas-alpha 11 crRNA
  misc_feature (30)..(49): n is a, c, g, or u
guuuuaguuuaacuaugugaaauguaaaunnnnnnnnnnnnnnnnnnnn

SEQ ID NO: 185 - RNA, 112 nt, Unknown
  Candidatus Micrarchaeota archaeon
auuguauuaugcuccacuuuaauaaguggugccuuccaaagcuauaugcugagggaggaugggcgcuguugcagcgucugcccaccucagaguggguauccuuaccuauuuu

SEQ ID NO: 186 - RNA, 122 nt, Unknown
  Candidatus Micrarchaeota archaeon
auuaugcuccacuuuaauaaguggugccuuccaaagcuauaugcugagggaggaugggcgcuguugcagcgucugcccaccucagaguggguauccuuaccuauuuugaaagguucuguaag

SEQ ID NO: 187 - RNA, 107 nt, Unknown
  Candidatus Micrarchaeota archaeon
auuaugcuccacuuuaauaaguggugccuuccaaagcuauaugcugagggaggaugggcgcuguugcagcgucugcccaccucagaguggguauccuuaccuauuuu

SEQ ID NO: 188 - RNA, 185 nt, Unknown
  Uncultured archaeon
gaauguuauuccauaauaacauuugaugcacacgauuccucccuacaguaguuagguauagccgaaagguagagacuaaaucuguaguuggagugggccgcuugcaucggccuaaaguugagaagugucagacucugauaacccucaacgacgauauucuuuauuucgguucaaaguucugcaca

SEQ ID NO: 189 - RNA, 156 nt, Unknown
  Uncultured archaeon
acacgauuccucccuacaguaguuagguauagccgaaagguagagacuaaaucuguaguuggagugggccgcuugcaucggccuaaaguugagaagugucagacucugauaacccucaacgacgauauucuuuauuucgguucaaaguucugcaca

SEQ ID NO: 190 - RNA, 131 nt, Unknown
  Uncultured archaeon
acacgauuccucccuacaguaguuagguauagccgaaagguagagacuaaaucuguaguuggagugggccgcuugcaucggccuaaaguugagaagugucagacucugauaacccucaacgacgauauucu

SEQ ID NO: 191 - RNA, 139 nt, Unknown
  Uncultured archaeon
acacgauuccucccuacaguaguuagguauagccgaaagguagagacuaaaucuguaguuggagugggccgcuugcaucggccuaaaguugagaagugucagacucugauaacccucaacgacgauauucuuuauuucg

SEQ ID NO: 192 - RNA, 160 nt, Parageobacillus thermoglucosidasius
aaaaucccuuggggcgauucagcguccuuaagucgagaagugccguaauaagcaucuaaaaaugccuaacgguaacacucgauaagguaguccugcuaggcaggcugaaacccuagccacaaaauccggcuaggcaucauacagaaaauuguugucgaac

SEQ ID NO: 193 - RNA, 140 nt, Parageobacillus thermoglucosidasius
aucccuuggggcgauucagcguccuuaagucgagaagugccguaauaagcaucuaaaaaugccuaacgguaacacucgauaagguaguccugcuaggcaggcugaaacccuagccacaaaauccggcuaggcaucauaca

SEQ ID NO: 194 - RNA, 126 nt, Acidibacillus sulfuroxidans
aaaucuuucccaaauacuucuauucgucgguucagcgacgauaagccgagaagugccaauaaaacuguuaagugguuugguaacgcucgguaagguagccaaaaggcugaaacuccgugcacaaag

SEQ ID NO: 195 - RNA, 113 nt, Acidibacillus sulfuroxidans
auacuucuauucgucgguucagcgacgauaagccgagaagugccaauaaaacuguuaagugguuugguaacgcucgguaagguagccaaaaggcugaaacuccgugcacaaag

SEQ ID NO: 196 - RNA, 86 nt, Acidibacillus sulfuroxidans
auacuucuauucgucgguucagcgacgauaagccgagaagugccaauaaaacuguuaagugguuugguaacgcucgguaagguagc

SEQ ID NO: 197 - RNA, 150 nt, Ruminococcus sp.
aagguucacacaauuucagggcgacucggcguccuaaaaucgagaaaguguacauaaguuuuuaacaaaauacgguaaauacucucgguaagguuuuaacgugcacauaauaauccgugcaacaggguuacacuuuugugcaauuuugca

SEQ ID NO: 198 - RNA, 129 nt, Ruminococcus sp.
uuucagggcgacucggcguccuaaaaucgagaaaguguacauaaguuuuuaacaaaauacgguaaauacucucgguaagguuuuaacgugcacauaauaauccgugcaacaggguuacacuuuugugca

SEQ ID NO: 199 - RNA, 129 nt, Syntrophomonas palmitatica
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgc

SEQ ID NO: 200 - RNA, 140 nt, Syntrophomonas palmitatica
auuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgc

SEQ ID NO: 201 - RNA, 153 nt, Syntrophomonas palmitatica
auuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaacugaguaau

SEQ ID NO: 202 - RNA, 158 nt, Syntrophomonas palmitatica
gcuuuaaagccugacauaauuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgc

SEQ ID NO: 203 - RNA, 171 nt, Syntrophomonas palmitatica
gcuuuaaagccugacauaauuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaacugaguaau

SEQ ID NO: 204 - RNA, 132 nt, Clostridium novyi
uaaaacauaguuaaacuaauaaaaacagggcgauuuaacguccuaaggcugagagaaguuuuuucuacucggcaaggguuaaucucgauuguuguguuaccgaucgagcguuucacaaaaugcgagagaaau

SEQ ID NO: 205 - RNA, 116 nt, Clostridium novyi
uaaaacauaguuaaacuaauaaaaacagggcgauuuaacguccuaaggcugagagaaguuuuuucuacucggcaaggguuaaucucgauuguuguguuaccgaucgagcguuucac

SEQ ID NO: 206 - RNA, 108 nt, Clostridium novyi
aguuaaacuaauaaaaacagggcgauuuaacguccuaaggcugagagaaguuuuuucuacucggcaaggguuaaucucgauuguuguguuaccgaucgagcguuucac

SEQ ID NO: 207 - RNA, 90 nt, Clostridium novyi
agggcgauuuaacguccuaaggcugagagaaguuuuuucuacucggcaaggguuaaucucgauuguuguguuaccgaucgagcguuucac

SEQ ID NO: 208 - RNA, 160 nt, Artificial
  Cas-alpha 2 sgRNA version 5
  misc_feature (141)..(160): n is a, c, g, or u
auuguauuaugcuccacuuuaauaaguggugccuuccaaagcuauaugcugagggaggaugggcgcuguugcagcgucugcccaccucagaguggguauccuuaccuauuuugaaaaaguaauaggucaaggaaugcaacnnnnnnnnnnnnnnnnnnnn

SEQ ID NO: 209 - RNA, 183 nt, Artificial
  Cas-alpha 2 sgRNA version 6
  misc_feature (164)..(183): n is a, c, g, or u
auuaugcuccacuuuaauaaguggugccuuccaaagcuauaugcugagggaggaugggcgcuguugcagcgucugcccaccucagaguggguauccuuaccuauuuugaaagguucuguaaggaaaauugcagaacccaaaguaauaggucaaggaaugcaacnnnnnnnnnnnnnnnnnnnn

SEQ ID NO: 210 - RNA, 155 nt, Artificial
  Cas-alpha 2 sgRNA version 7
  misc_feature (136)..(155): n is a, c, g, or u
auuaugcuccacuuuaauaaguggugccuuccaaagcuauaugcugagggaggaugggcgcuguugcagcgucugcccaccucagaguggguauccuuaccuauuuugaaaaaguaauaggucaaggaaugcaacnnnnnnnnnnnnnnnnnnnn

SEQ ID NO: 211 - RNA, 246 nt, Artificial
  Cas-alpha 6 sgRNA version 1
  misc_feature (227)..(246): n is a, c, g, or u
gaauguuauuccauaauaacauuugaugcacacgauuccucccuacaguaguuagguauagccgaaagguagagacuaaaucuguaguuggagugggccgcuugcaucggccuaaaguugagaagugucagacucugauaacccucaacgacgauauucuuuauuucgguucaaaguucugcacagaaaguugcagaacccgaauagacgaaugaaggaaugcaacnnnnnnnnnnnnnnnnnnnn

SEQ ID NO: 212 - RNA, 217 nt, Artificial
  Cas-alpha 6 sgRNA version 2
  misc_feature (198)..(217): n is a, c, g, or u
acacgauuccucccuacaguaguuagguauagccgaaagguagagacuaaaucuguaguuggagugggccgcuugcaucggccuaaaguugagaagugucagacucugauaacccucaacgacgauauucuuuauuucgguucaaaguucugcacagaaaguugcagaacccgaauagacgaaugaaggaaugcaacnnnnnnnnnnnnnnnnnnnn

SEQ ID NO: 213 - RNA, 181 nt, Artificial
  Cas-alpha 6 sgRNA version 3
  misc_feature (162)..(181): n is a, c, g, or u
acacgauuccucccuacaguaguuagguauagccgaaagguagagacuaaaucuguaguuggagugggccgcuugcaucggccuaaaguugagaagugucagacucugauaacccucaacgacgauauucugaaacgaauagacgaaugaaggaaugcaacnnnnnnnnnnnnnnnnnnnn

SEQ ID NO: 214 - RNA, 181 nt, Artificial
  Cas-alpha 6 sgRNA version 4
  misc_feature (162)..(181): n is a, c, g, or u
acacgauuccucccuacaguaguuagguauagccgaaagguagagacuaaaucuguaguuggagugggccgcuugcaucggccuaaaguugagaagugucagacucugauaacccucaacgacgauauucuuuauuucggaaacgaaugaaggaaugcaacnnnnnnnnnnnnnnnnnnnn

SEQ ID NO: 215 - RNA, 214 nt, Artificial
  Cas-alpha 7 sgRNA version 1
  misc_feature (195)..(214): n is a, c, g, or u
aaaaucccuuggggcgauucagcguccuuaagucgagaagugccguaauaagcaucuaaaaaugccuaacgguaacacucgauaagguaguccugcuaggcaggcugaaacccuagccacaaaauccggcuaggcaucauacagaaaauuguugucgaacgaaaguuucugaagaaacuauguaugaugugaagnnnnnnnnnnnnnnnnnnnn

SEQ ID NO: 216 - RNA, 194 nt, Artificial
  Cas-alpha 7 sgRNA version 2
  misc_feature (175)..(194): n is a, c, g, or u
aucccuuggggcgauucagcguccuuaagucgagaagugccguaauaagcaucuaaaaaugccuaacgguaacacucgauaagguaguccugcuaggcaggcugaaacccuagccacaaaauccggcuaggcaucauacagaaaguuucugaagaaacuauguaugaugugaagnnnnnnnnnnnnnnnnnnnn

SEQ ID NO: 217 - RNA, 178 nt, Artificial
  Cas-alpha 7 sgRNA version 3
  misc_feature (159)..(178): n is a, c, g, or u
aucccuuggggcgauucagcguccuuaagucgagaagugccguaauaagcaucuaaaaaugccuaacgguaacacucgauaagguaguccugcuaggcaggcugaaacccuagccacaaaauccggcuaggcaucauacagaaauguaugaugugaagnnnnnnnnnnnnnnnnnnnn

SEQ ID NO: 218 - RNA, 179 nt, Artificial
  Cas-alpha 8 sgRNA version 1
  misc_feature (160)..(179): n is a, c, g, or u
aaaucuuucccaaauacuucuauucgucgguucagcgacgauaagccgagaagugccaauaaaacuguuaagugguuugguaacgcucgguaagguagccaaaaggcugaaacuccgugcacaaaggaaaguuugcgagcuagcuuguggagugugaacnnnnnnnnnnnnnnnnnnnn

SEQ ID NO: 219 - RNA, 166 nt, Artificial
  Cas-alpha 8 sgRNA version 2
  misc_feature (147)..(166): n is a, c, g, or u
auacuucuauucgucgguucagcgacgauaagccgagaagugccaauaaaacuguuaagugguuugguaacgcucgguaagguagccaaaaggcugaaacuccgugcacaaaggaaaguuugcgagcuagcuuguggagugugaacnnnnnnnnnnnnnnnnnnnn

SEQ ID NO: 220 - RNA, 139 nt, Artificial
  Cas-alpha 8 sgRNA version 3
  misc_feature (120)..(139): n is a, c, g, or u
auacuucuauucgucgguucagcgacgauaagccgagaagugccaauaaaacuguuaagugguuugguaacgcucgguaagguagcgaaaguuugcgagcuagcuuguggagugugaacnnnnnnnnnnnnnnnnnnnn

SEQ ID NO: 221 - RNA, 131 nt, Artificial
  Cas-alpha 8 sgRNA version 4
  misc_feature (112)..(131): n is a, c, g, or u
auacuucuauucgucgguucagcgacgauaagccgagaagugccaauaaaacuguuaagugguuugguaacgcucgguaagguagcgaaagcuagcuuguggagugugaacnnnnnnnnnnnnnnnnnnnn

SEQ ID NO: 222 - RNA, 206 nt, Artificial
  Cas-alpha 9 sgRNA version 1
  misc_feature (187)..(206): n is a, c, g, or u
aagguucacacaauuucagggcgacucggcguccuaaaaucgagaaaguguacauaaguuuuuaacaaaauacgguaaauacucucgguaagguuuuaacgugcacauaauaauccgugcaacaggguuacacuuuugugcaauuuugcagaaaguugcaacuuacgcauagguguaaaauacgagnnnnnnnnnnnnnnnnnnnn

SEQ ID NO: 223 - RNA, 185 nt, Artificial
  Cas-alpha 9 sgRNA version 2
  misc_feature (166)..(185): n is a, c, g, or u
uuucagggcgacucggcguccuaaaaucgagaaaguguacauaaguuuuuaacaaaauacgguaaauacucucgguaagguuuuaacgugcacauaauaauccgugcaacaggguuacacuuuugugcagaaaguugcaacuuacgcauagguguaaaauacgagnnnnnnnnnnnnnnnnnnnn

SEQ ID NO: 224 - RNA, 176 nt, Artificial
  Cas-alpha 9 sgRNA version 3
  misc_feature (157)..(176): n is a, c, g, or u
uuucagggcgacucggcguccuaaaaucgagaaaguguacauaaguuuuuaacaaaauacgguaaauacucucgguaagguuuuaacgugcacauaauaauccgugcaacaggguuacacuuuugugcagaaauacgcauagguguaaaauacgagnnnnnnnnnnnnnnnnnnnn

SEQ ID NO: 225 - RNA, 185 nt, Artificial
  Cas-alpha 10 sgRNA version 1
  misc_feature (166)..(185): n is a, c, g, or u
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaacnnnnnnnnnnnnnnnnnnnn

SEQ ID NO: 226 - RNA, 196 nt, Artificial
  Cas-alpha 10 sgRNA version 2
  misc_feature (177)..(196): n is a, c, g, or u
auuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaacnnnnnnnnnnnnnnnnnnnn

SEQ ID NO: 227 - RNA, 209 nt, Artificial
  Cas-alpha 10 sgRNA version 3
  misc_feature (190)..(209): n is a, c, g, or u
auuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaacugaguaaugaaagucgcaucuugcguaagcgcguggauugaaacnnnnnnnnnnnnnnnnnnnn

SEQ ID NO: 228 - RNA, 214 nt, Artificial
  Cas-alpha 10 sgRNA version 4
  misc_feature (195)..(214): n is a, c, g, or u
gcuuuaaagccugacauaauuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaacnnnnnnnnnnnnnnnnnnnn

SEQ ID NO: 229 - RNA, 227 nt, Artificial
  Cas-alpha 10 sgRNA version 5
  misc_feature (208)..(227): n is a, c, g, or u
gcuuuaaagccugacauaauuuacucuguuucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaacugaguaaugaaagucgcaucuugcguaagcgcguggauugaaacnnnnnnnnnnnnnnnnnnnn

SEQ ID NO: 230 - RNA, 185 nt, Artificial
  Cas-alpha 11 sgRNA version 1
  misc_feature (166)..(185): n is a, c, g, or u
uaaaacauaguuaaacuaauaaaaacagggcgauuuaacguccuaaggcugagagaaguuuuuucuacucggcaaggguuaaucucgauuguuguguuaccgaucgagcguuucacaaaaugcgagagaaaugaaaguuuuaguuuaacuaugugaaauguaaaunnnnnnnnnnnnnnnnnnnn

SEQ ID NO: 231 - RNA, 169 nt, Artificial
  Cas-alpha 11 sgRNA version 2
  misc_feature (150)..(169): n is a, c, g, or u
uaaaacauaguuaaacuaauaaaaacagggcgauuuaacguccuaaggcugagagaaguuuuuucuacucggcaaggguuaaucucgauuguuguguuaccgaucgagcguuucacgaaaguuuuaguuuaacuaugugaaauguaaaunnnnnnnnnnnnnnnnnnnn

SEQ ID NO: 232 - RNA, 161 nt, Artificial
  Cas-alpha 11 sgRNA version 3
  misc_feature (142)..(161): n is a, c, g, or u
aguuaaacuaauaaaaacagggcgauuuaacguccuaaggcugagagaaguuuuuucuacucggcaaggguuaaucucgauuguuguguuaccgaucgagcguuucacgaaaguuuuaguuuaacuaugugaaauguaaaunnnnnnnnnnnnnnnnnnnn

SEQ ID NO: 233 - RNA, 145 nt, Artificial
  Cas-alpha 11 sgRNA version 4
  misc_feature (126)..(145): n is a, c, g, or u
aguuaaacuaauaaaaacagggcgauuuaacguccuaaggcugagagaaguuuuuucuacucggcaaggguuaaucucgauuguuguguuaccgaucgagcguuucacgaaagugaaauguaaaunnnnnnnnnnnnnnnnnnnn

SEQ ID NO: 234 - RNA, 127 nt, Artificial
  Cas-alpha 11 sgRNA version 5
  misc_feature (108)..(127): n is a, c, g, or u
agggcgauuuaacguccuaaggcugagagaaguuuuuucuacucggcaaggguuaaucucgauuguuguguuaccgaucgagcguuucacgaaagugaaauguaaaunnnnnnnnnnnnnnnnnnnn

SEQ ID NO: 235 - DNA, 1590 bp, Artificial
  Cas-alpha 4 Zea mays codon optimized gene
atggccaagaacaccatcaccaagaccctcaagctccgcatcgtccgcccctacaacagcgccgaggtcgagaagatcgtcgccgacgagaagaacaaccgcgagaagatcgccctggagaagaacaaggacaaggtcaaggaggcctgcagcaagcacctcaaggtcgccgcctactgcaccacccaggtcgagcgcaacgcctgcctcttctgcaaggcccgcaagctcgacgacaagttctaccagaagctccgcggccagttccccgacgccgtgttctggcaggagatcagcgagatcttcaggcagctccagaagcaggccgccgagatctacaaccagagcctcatcgagctctactacgagatcttcatcaagggcaagggcatcgccaacgccagcagcgtcgagcactacctcagcgacgtctgctacaccagggccgccgagctcttcaagaacgccgccatcgccagcggcctccgcagcaaaatcaaaagcaacttccgcctcaaggagctcaagaacatgaaaagcggcctccccacgaccaagagcgacaacttccccatccccctcgtcaagcagaagggcggccagtacaccggcttcgagatcagcaaccacaacagcgacttcatcatcaagatccccttcggccgctggcaggtcaagaaggagatcgacaagtaccgcccctgggagaagttcgacttcgagcaggtccagaagagccccaagcctatcagcctcctcctgtcgacccagaggaggaagcgcaataaaggctggagcaaggacgagggcaccgaggccgaaatcaaaaaggtgatgaacggcgactaccagaccagctacatcgaggtcaagcgcggcagcaagatcggcgagaagagcgcctggatgctaaacctcagcatcgacgtccccaagatcgacaagggcgtcgaccccagcatcatcggcggcatcgacgtcggcgtcaagagccccctcgtctgcgcaattaacaacgccttcagccgctacagcatcagcgacaacgacctcttccacttcaacaagaagatgttcgcccgccgccgcatcctcctcaagaagaaccgccataaacgcgccggccacggcgccaagaacaagctcaagcccatcaccatcctcaccgagaagagcgagaggttccgcaagaagctcatcgagaggtgggcctgcgagatcgccgacttcttcattaaaaacaaggtcggcaccgtccagatggagaacctcgaaagcatgaaacgcaaggaggacagctacttcaacatcaggctccgcggcttctggccctacgccgagatgcagaacaagatcgagttcaagctcaagcagtacggcatcgagatcaggaaggtcgcccccaataataccagcaagacctgcagcaagtgcggccacctcaacaactacttcaacttcgagtaccgcaagaagaacaagttcccccacttcaagtgcgagaagtgcaacttcaaggagaacgccgactacaacgccgccctcaacatcagcaaccccaagctcaagagcaccaaggaggagccctag

SEQ ID NO: 236 - DNA, 1494 bp, Artificial
  Cas-alpha 10 Zea mays codon optimized gene
atgggcgagagcgtcaaggcaataaaattaaagatcctcgacatgttcctcgaccccgagtgcaccaagcaggacgacaactggcgcaaggacctcagcaccatgagccgcttctgcgccgaggccggcaacatgtgcctcagggacctctacaactacttcagcatgcccaaggaggaccgcatcagctccaaggacttatataacgccatgtaccataaaactaagctcctccaccccgagctccccgggaaggtggctaaccaaatcgtcaaccacgccaaggacgtctggaagcgcaacgccaagctcatctaccgcaaccaaatcagcatgcccacatataagatcaccaccgcccccatccgcctccaaaataacatctacaaattaataaaaaataagaacaaatacataatcgacgtccagctctacagcaaggagtacagcaaggacagcggcaagggcacccacaggtacttcctcgtcgccgtcagggacagcagcaccaggatgatcttcgacaggatcatgagcaaggaccacatcgacagcagcaagagctacacccagggccagctccaaatcaagaaggaccaccagggcaagtggtactgcatcatcccctatacattccccacccacgaaaccgtcctcgaccccgacaaggtcatgggcgtcgacctcggggtggctaaggccgtctactgggctttcaacagcagctataaaagaggctgcatcgacggcggcgagatcgagcacttcaggaagatgatcagggcccggcgcgtcagcatccagaatcaaatcaaacacagcggcgacgcccgcaagggccacggcaggaagagggccctcaagcccatcgaaaccctcagcgagaaggagaagaacttccgcgacacaataaaccacaggtacgccaacaggatcgtcgaggccgctatcaagcagggctgcggcaccatccagatcgagaacctcgagggcatcgctgacaccaccggcagcaagttcctcaagaactggccctactacgacctccagaccaagatcgtcaataaagccaaggagcacggcatcaccgtcgtcgcaataaacccccagtatacatcccagcgctgcagcatgtgcggctacatcgagaaaaccaacaggagcagccaggccgtgttcgagtgcaagcagtgcggctacggcagccgcaccatctgcatcaactgcaggcacgtccaagtctccggcgacgtctgcgaggagtgcggcggcatcgtcaagaaggagaacgtcaacgccgactacaacgccgccaagaacatcagcaccccctacatcgaccagataataatggagaagtgcctcgagctcggcatcccctaccgctccatcacctgcaaggagtgcggccacatccaggctagcggcaacacctgcgaggtctgcggcagcaccaacatcctcaaaccaaagaagatccgcaaggcaaaatag

SEQ ID NO: 237 - DNA, 1494 bp, Artificial
  Cas-alpha 10 Saccharomyces cerevisiae codon optimized gene
atgggagaatccgtgaaggccatcaaactgaagatcctggacatgttcctggacccagagtgtaccaaacaggacgacaactggagaaaggacctgagtaccatgtccaggttctgcgctgaagccggcaacatgtgtttgagggacctatacaactacttctccatgccaaaggaggaccgtatctcttccaaagacctatacaacgccatgtaccacaaaaccaagctgctgcacccagaactgcccggcaaagttgcaaaccaaatcgtcaaccacgccaaggacgtctggaaaaggaacgccaagctgatatacaggaaccagatctccatgccaacatacaagatcaccaccgcccccatcaggctgcagaacaacatctacaagctgatcaagaacaagaacaagtacataatcgacgtccagctgtacagtaaggagtactcaaaggacagtggcaaaggcacccataggtacttcctggtcgcagtcagagactcatccaccaggatgatcttcgacaggataatgtccaaggatcacatcgacagttccaagtcctacacccagggacagctgcagatcaagaaggaccaccagggcaagtggtactgcatcatcccctacaccttcccaactcatgagacagtgttagaccccgacaaggtgatgggagtggacctgggcgtcgctaaagccgtctactgggccttcaacagttcctacaagaggggctgcatcgacggaggcgaaatcgagcatttccgcaagatgatcagggccaggagggtcagtatccagaaccagatcaaacacagtggagacgcccgtaagggccacggaaggaagcgtgctttgaagccaatcgagaccctgtctgagaaggaaaaaaacttcagggacaccatcaaccacaggtacgccaacaggatcgtcgaagccgccatcaagcagggctgcggaaccatccagatcgagaacctggaaggaatcgctgataccaccggctccaagttcctgaagaactggccatactacgacctgcagaccaagatcgtcaacaaggccaaggagcacggaatcaccgtggttgccatcaacccacaatatacctcccagaggtgctccatgtgcggctacatcgagaagacaaacagatcctcccaggctgtcttcgaatgcaagcagtgcggctacggttccaggaccatctgcatcaactgcagacacgtccaagtttccggtgacgtctgcgaagagtgcggcggtatcgtcaaaaaggagaacgtgaacgcagactacaacgccgccaagaatatcagtaccccctacatcgaccagataatcatggagaaatgcctggagctaggcatcccctacaggtccatcacatgcaaggagtgtggccacatccaagccagtggcaatacctgcgaagtctgcggcagtaccaatatcctgaaacccaagaagatcaggaaggccaagtaa

SEQ ID NO: 238 - RNA, 202 nt, Artificial
  Cas-alpha 4 sgRNA backbone
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaac

SEQ ID NO: 239 - RNA, 165 nt, Artificial
  Cas-alpha 10 sgRNA backbone
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaac

SEQ ID NO: 240 - RNA, 20 nt, Artificial
  Cas-alpha 4 Liguleless 2 sgRNA Target Sequence
cgauuuauggaugauaaacu

SEQ ID NO: 241 - RNA, 20 nt, Artificial
  Cas-alpha 4 Liguleless 3 sgRNA Target Sequence
uaguuuaucauccauaaauc

SEQ ID NO: 242 - RNA, 20 nt, Artificial
  Cas-alpha 10 nptII sgRNA Target Sequence
cuugcgcagcugugcucgac

SEQ ID NO: 243 - RNA, 20 nt, Artificial
  Cas-alpha 10 ms26 sgRNA Target Sequence
aaguucacggcguuccaggc

SEQ ID NO: 244 - RNA, 20 nt, Artificial
  Cas-alpha 10 ade2 sgRNA Target Sequence
uuuaguguaggaacaucaac

SEQ ID NO: 245 - RNA, 20 nt, Artificial
  Cas-alpha 4 VEGFA 2 sgRNA Target Sequence
ggggugaccgccggagcgcg

SEQ ID NO: 246 - RNA, 20 nt, Artificial
  Cas-alpha 4 VEGFA 3 sgRNA Target Sequence
gccagagccggggugugcag

SEQ ID NO: 247 - RNA, 222 nt, Artificial
  Cas-alpha 4 sgRNA Targeting Liguleless 2
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaaccgauuuauggaugauaaacu

SEQ ID NO: 248 - RNA, 222 nt, Artificial
  Cas-alpha 4 sgRNA Targeting Liguleless 3
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacuaguuuaucauccauaaauc

SEQ ID NO: 249 - RNA, 185 nt, Artificial
  Cas-alpha 10 sgRNA Targeting nptII
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaaccuugcgcagcugugcucgac

SEQ ID NO: 250 - RNA, 185 nt, Artificial
  Cas-alpha 10 sgRNA Targeting ms26
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaacaaguucacggcguuccaggc

SEQ ID NO: 251 - RNA, 185 nt, Artificial
  Cas-alpha 10 sgRNA Targeting ade2
uucgcgcgccagggcaguuaggugcccuaaaagagcgaaguggccgaaaggaaaggcuaacgcuucucuaacgcuacggcgaccuuggcgaaaugccaucaauaccacgcggcccgaaaggguucgcgcgaaagucgcaucuugcguaagcgcguggauugaaacuuuaguguaggaacaucaac

SEQ ID NO: 252 - RNA, 222 nt, Artificial
  Cas-alpha 4 sgRNA Targeting VEGFA 2
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacggggugaccgccggagcgcg

SEQ ID NO: 253 - RNA, 222 nt, Artificial
  Cas-alpha 4 sgRNA Targeting VEGFA 3
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacgccagagccggggugugcag

SEQ ID NO: 254 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKVFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNKDVILNLVIDIPQNSNVYKPVEGRILGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYANPAYTSQKCSRCGEIDKENRQTQANFKCTKCGFELNADHNAAINIARSIEFV

SEQ ID NO: 255 - protein, 448 aa, Clostridium paraputrificum
MNFNKCIKVTLIKCLNYDYRKVKQIIKDFQYKYSKAYNMATNYLYLWDTNSMNLKNLYDTKIVDKELLGKSKGAWIENRMNEIIEGALSNNVAQARQDIINKYNKCKKDGLFKGKVSLPTYKLDSKVIVHNVAYKLRNHNGYFIDIGLLNKGKQKELNVGRFEFQIDKLDGNKKATINKIINGEYKQGSAQISISKKGKIELIISYSFDKEEIPVLDNNRILGIDLGITNVATMSVYDSIKDEYDYFSWKTNVIRGKELIAFRQKYYNLRRDISIASKTAGKGRCGHGYKTKMKPVDKVRNRIANFADTYNHKISKYIVEFAVKNRCGIIQMEDLSGATSEVHNKMLKDWSYYDLQQKIEYKAKEQGIEIKKVNPKYTSKRCNNCGCIHEDNRDCKNHQARFECKVCGHGKDTDVNADVNASRNIAIPDIDKIIEETEILHSENKPAS

SEQ ID NO: 256 - protein, 430 aa, Clostridium novyi
MNKCIKVAIKNCKELDYKVMSEKLRNIQYLTCKASNKVMQMYYMWENQKIDIKNKTGEYPDDKELFGKTYRNVVEGEMKTIMNTINTSNVGQTNAIIMKKWNTDKKEVLSYQKSLPNFKLNMPIYIKNKSFSIVKGTSGYEIICSIFNKSQDLKRLTFIIDKLDGNKKATLNKIIDLTYKQGAGQIIKDRKGKWYFIISFGFENKKRELDINRILGIDVGITNLLTMQIWDCNLKEWDRLAWNSCMVDGRELMHYRQKIEARRKSLLKNSKISEKNTGKAGHGISKRIQAIDVVRNKEKNFRDTFNHKYSRYAVDFAIRNNCGIIQMENLAKFTEEVKEKMLKNWSYYDLQSKIKYKAEEQGIKVNFIKPSYTSKRCSLCGAIDDRNRDCKNNQSKFQCVVCDHKEHADINAAKNIALPDIEELIESKIG

SEQ ID NO: 257 - protein, 436 aa, Ruminococcus albus
MNKVVRLALICEHFDKDGNPVDYSDVYKLLWQLQAQTREIKNKTIQYCWEYSNFSSDYYKENHEYPKEKDVLNYTLGGFVNDKFKVGNDLYSANCSTTTQTVCAEFKNSKSEFLKGTKSIINYKSNQPLDLHNKSIRVEYKDNDFFVFLKLLNRHAFKRLGYKNTEICFKVIVRDKSTRTILERCVDQIYGISASKLIYNKKKKQWFLNLVYAFEPDNANNLDPNRILGVDLGIHYPICASVYGDLQRFTIHGGEIEEFRRRVESRKLSLLKQGKNCGDGRIGHGVKTRNKPVYSIEDRIARFRDTVNHKYSRALIDYAVKKECGTIQMEDLSGITAESDRFLKNWSYYDLQTKIEYKAKEKGIKIVYIDPKYSSQRCSKCGHIDKENRKTQSSFVCLKCGFEENADYNASQNIGIKDIDKIIESDLSSKCETDVN

SEQ ID NO: 258 - protein, 402 aa, Clostridium hiranonis
MITVRKLKLTIINDDETKRNEQYKFIRDSQYAQYQGLNLAMSVLTNAYLSSNRDIKSDLFKETQKNLKNSSHIFDDITFGKGTDNKSLINQKVKKDFNSAIKNGLARGERNITNYKRTFPLMTRGTALKFSYKDDCSDEIIIKWVNKIVFKVVIGRKDKNYLELMHTLNKVINGEYKVGQSSIYFDKSNKLILNLTLYIPEKKDDDAINGRTLGVDLGIKYPAYVCLNDDTFIRQHIGESLELSKQREQFRNRRKRLQQQLKNVKGGKGREKKLAALDKVAVCERNFVKTYNHTISKRIIDFAKKNKCEFINLEQLTKDGFDNIILSNWSYYELQNMIKYKADREGIKVRYVNPAYTSQKCSKCGYIDKENRPTQEKFKCIKCGFELNADHNAAINISRLEE

SEQ ID NO: 259 - protein, 493 aa, Clostridium ihumii
MKTTEKNVLMTKCIKVTLNRCVNYNMKEIMNIIREMQYLSSKAYNLATNYLYIWDTNSMNFKNLYEEKIVDKDLLGKSKSAWIENRMNEIMKGFLTNNVAQARQDVINKYNKSKKDGLFIGKVTLPSYKMNGKVVIHNKAYRFSKNEGYFVEIGLFNKEKKEELNCDWIKFKLDKIDSNKKATIYKILNGDYKQGSAQLHINKKGKIEFIISYSFERENSIKLDKNRTLGIDIGIVNIAAMAIWDNNKQEWELTRYSHNLISGNEAIALRQKYYKLGLRNKELEKNINRELHELEEKEYRGLSTNIISGHNLTYKRIMLNSKRIRLSQSCKWCGNSKVGHGRRVRCKQVDKIGNKIERFKDTFNHKYSRYIVDFAVKNNCGIIQMENLKNFNPSEKFLKDWPYFDLQTKIEYKAKEYGIEVIKVNPKYTSKRCSRCGCINELNRDCKKNQSKFKCVNDECNNYENADINAAKNIALPYIDKIIEQCLETNKVV

SEQ ID NO: 260 - protein, 398 aa, Cellulosilyticum ruminicola
MIAVRKLKIMVLCDDESKKNEQYKFLRDSQYAQYLGLNRAMSFLAKEYLSGDKERFKEAKKKLTNTCECYQNINFGTGIDSKSQITQKVKKDLQADIKNGLARGERSIRNYRRTFPLITRGRDLKFSYNGDEIIIKWVNKIYFKVLIGRKDKNYLELMHTLEKIINGEYKVCTSSIQIDKKLILNLTLEIPDKVKKEFQENRVLGVDLGIKFPAYACVSDNTYVRRSFGSIDEFLKVRIQFDKRRKRIQQQLQNVKGGKGRKDKLQALDRMRDCERKWVRNYNHALSKRIIDFAFRNKCGIIHLEKLEKDGFKNKLLRNWSYYELQDMIGYKAEREGIVVKYVEPAYTSQTCSKCGYVDRENRPSQEHFLCKECGFEINADHNAAINIARSNKVIVDK

SEQ ID NO: 261 - protein, 433 aa, Eubacterium siraeum
MVCNKVIKIALICDQIDKDGKDVNYNDIYKLLWDLQKQTREAKNKVIRLCWEWSGYSSEYFKTHEEYPKDKEIFGISLRGYLYDRIKGDYNLYSGNLSQSAEIAYKEYKNSLKDVLRGDKSIINYRENQPLDIKNKAIQLLYENDNFFVRVALINKDKQKELNFKDCSVRFKLLVKDDSTRTILERCFDEVYTITASKIMYNKKKKQWYINLGYKFTKEIDKTLDKDRILGVDLGVINPLVASVYGSYDRLIIGGGEIDKFRKRVEANKVQMLKQGKYCGDGRIGHGVNTRNKPAYNIEDKISRFRDTVNHKYSKAVVDYAVKNNCGTIQMEDLKGITQNKNERYLKNWTYFDLQTKIEYKAKALGIEVKYKNPKYTSQRCSKCGHIAEENRPEQKTFKCVKCGFKVNADYNASQNLAIKDIDKIIEQYYNKG

SEQ ID NO: 262 - protein, 482 aa, Clostridium botulinum
MNTVRKIKLTILGDTETRNKQYKWIRDEQYNQYRALNLSMTYMVTNLMLKNNESGLENRKEKDILKIENKIKKDEGSLKKELAKKRINEEKIENIKSNIEELKSQKEKLENELKNIKEYRSNIDEEFKKMYVNDLYNVLNKISFQHEDMKSLVTQRVKKDFNNDVKEIMRGDRSVRNYKRNFPILTRGRDLKFQYFEKSEDIEIKWIEGIKFKCILGRPSKSLELKHTLHKVINEEYKICDSSLQFDKNNNLILNLTLDIPENNKYEKIENRIVGVDLGLKIPAYVALNDTRYIRKAIGSINDFLKVRTQIQSRARKLQKSLQVVRGGKGRNKKMKALERFREKERNFARNYNHFLSYNIVKFALDNKAEQINLELLEMKKTQNKSILRNWSYYQLQSFIEYKAERVGIKVKYIDPYHTSQICSECGNYEEGQRVEQDTFVCKRCGHKINADYNAARNIAMSDNYISKKEESQYYKNNKNMV

SEQ ID NO: 263 - protein, 482 aa, Clostridium botulinum
MNTVRKIKLTILGDTETRNKQYKWIRDEQYNQYRALNLSMTYMVTNLMLKNNESGLENRKEKDILKIENKIKKDEENLKKELAKKKINEEKNENIKSNIEELKSEKEKLENELKNIKEYRSNIDEEFKKMYVDDLYNVLNKISFQHEDMKSLVTQRVKKDFNNDVKEIMRGDRSVRNYKRNFPILTRGRDLKFQYIEKSEDIEIKWIEGIKFKCILGKPSKSLELKHALHKVINKEYKVCDSSLQFDKNNNLILNLTLDIPQDNKYEKITNRVVGVDLGLKIPAYVALNDTKYIRKAIGSIDDFLKVRTQIQSRVRKLQKSLQVVRGGKGRNKKMKALEKFREKERNFARNYNHFLSYNIVKFALDNKAEQINLELLEMKKTQNKSILRNWSYYQLQNFIEYKAERVGIKVKYIDPYHTSQTCSECGNYEEGQRVEQDTFVCKRCWHKMNADYNAARNIAMSYNYISKKEESEYYKNNKNMV

SEQ ID NO: 264 - protein, 424 aa, Ruminiclostridium hungatei
MATKVMRYQIIKPIDCNWDLFGKVLRDIQYDTRQIMNRTIQYCWEWQGYSSDYKIAKGEYPKTRETFGYSDMRGYAYDKLKSIYQRLNTANLTTSITRAVQRWKTDTKDVIRGDKSIACFRADVPIDLHNKSMNIEKSDDGYIVALSLASNIYKKELDRNSGQFSVLINEGNKSNRDVLDRCIAGQYKISASQILREKNKWFLNLSYSFEISKPDKSRDNILGIDVGIVHPVYMAVYNSPARRSISGGEIDNFRKQVQKRIKELQLQGKQCGEGRIGHGIKTRVKPIEFAKDKVANFRNTINHKYSKAIVEFAIKNGCGIIQMEDLKGINTDNVFLKNWTYYDLQQKVKYKAELEGIEVKLIDPQYTSQRCCKCGYIHRDNRPEQAKFKCIDCGFEVNADYNASLNIATPDIDKIILEFLKCET

SEQ ID NO: 265 - protein, 451 aa, Desulfovibrio fructosivorans
MAITKVVKIPLVIDESDEILRKIKYRAFDKVMNEARYLGNLAIRYAIAYGLENIPNQIDAETGKQIALDTTIYRHLAEKRKYLPAGNMATLERNFAVKTYRNTNKDAWAGRKSLPTYRSLFVPFRHTGTKIAVVERNGTKQFCIDPQGFGASWLSDELIAEVHDGPIAIEKQRRKLTLVSCFSWRDQGAVEIVQRIVNGEYKLSDGQIQMGKKGLVALLPYSFDAIQPELDPARVCGIDLGAVIPAVCAVNFGPQRAYLGEGKDVWAARSRFRAERRRLQSRAGLYSKTKNWRRSEKEDNWIQTYYHALTRKVIKFCVQHGCGTIHMEDLSSLRQRDVESEFRRLLWVPSKFFELLSYKAKEMGIGIVKINPRNTSKRCSECGHISKGNRKSQEKFVCEKCGEGKRPVNADYNAARNIALATGDVLLHGYIESEPDALGEMDQLWEGAQEA

SEQ ID NO: 266 - protein, 451 aa, Bacillus toyonensis
MGVTIKIMKYQILCPMNVDWTIFEKQLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 267 - protein, 451 aa, Clostridium paraputrificum
MRIMNFNKCIKVTLIKCLNYDYRKVKQIIKDFQYKYSKAYNMATNYLYLWDTNSMNLKNLYDTKIVDKELLGKSKGAWIENRMNEIIEGALSNNVAQARQDIINKYNKCKKDGLFKGKVSLPTYKLDSKVIVHNVAYKLRNHNGYFIDIGLLNKGKQKELNVGRFEFQIDKLDGNKKATINKIINGEYKQGSAQISISKKGKIELIISYSFDKEEIPVLDNNRILGIDLGITNVATMSVYDSIKDEYDYFSWKTNVIRGKELIAFRQKYYNLRRDISIASKTAGKGRCGHGYKTKMKPVDKVRNRIANFADTYNHKISKYIVEFAVKNRCGIIQMEDLSGATSEVHNKMLKDWSYYDLQQKIEYKAKEQGIEIKKVNPKYTSKRCNNCGCIHEDNRDCKNHQARFECKVCGHGKDTDVNADVNASRNIAIPDIDKIIEETEILHSENKPAS

SEQ ID NO: 268 - protein, 437 aa, Clostridium ventriculi
MTTKCVQVAIEYSSNNILKEVDFYKELRDLQYNSYLACNRAISYMYENDMQNFIIKETDLPRSDDKKLYGKSFAAWIENRMNEYMPGALSNNVAQTRQFVVNRYKNDKKAGLLKGNVSLTTFKRTNPIIIHNNAYNIIETPKGLGAEIGFFNLPKQKELGIKRVNFLFPKLGSSEKSIIRRLLDKSYKQGAMQISYNQKKKKWMATISFSFNLEEIKTNENLVMGIDLGVSKVATLSIYDASKYEYIKMSFKDTCIDGTELMHYRQKLESRRKALSIASKWASDNNRGHGYKTKMEKANYMGRKYNNFRDTYNHKVSRYIVDVAIKYRVGLIQMEDLSGFSEQQQESLLKNWSYYDLQQKIKYKAEENGIRVYFINPKYTSQRCSKCGNIDKENRKTQESFSCTVCNYKDNADVNASKNIAIPDIEKIIEEQVKKQY

SEQ ID NO: 269 - protein, 440 aa, Ruminococcus sp.
MVKVVKIHLISEQFDKAGNRIDYEEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNQFYVRLALLKKAEFAKYGFKDGFHFKMQVKDNSTKTILERCFDEVYKINASKLLYDQKKKKWKLNLSYSFDNKNISELDKEKILGVDVGVSYPLVASVFGDRDRFKIKGGEIEKFRKSVEARRRSMLEQTKYCGDGRIGHGRKKRTEPALNIGDKIARFRDTTNHKYSRALIEYAVKKGCGTIQMEKLTGITSKADRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 270 - protein, 439 aa, Ruminococcus sp.
MVKVVKIHLISEQFDKAGNRIDYKEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNQFYVRLALLKKAGFAKYGFKDGFRFKMQVKDNSTKTILERCFDGIYTIVASKLLYDQKKNRWKLNLSYSFDNKNISELDKEKILGVDVGVSYPLVASVFGDRDRFKIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIESKANEAGIKVVYIAPEYTSQRCSKCGYIHKDNRPNQAKFRCLKCDFESNADYNASQNIGIKNIDKTIKKERKKQKSEAQVNEK

SEQ ID NO: 271 - protein, 402 aa, Peptoclostridium sp.
MITVRKLKLTIINDDETKRNEQYKFIRDSQYAQYQGLNLAMSVLTNAYLSANRDIKSDLFKETQKNLKNSSSIFNDIPFGKGIDSKSSITQKVKQDFSIAIKNGLAGGERNITNYKRTFPLMTRGRDLKFSYKDDCSDEIIIKWVNKIVFKVVIGRKDKNYLELMHTLNKVINGEYKVGQSSIYFDKSNKLILNLTLYIPEKKDDDAINGRTLGVDLGIKYPAYVCLNDDTFIRQHIGESLELSKQREQFRNRRKRLQQQLKNVKGGKGREKKLSALDKVAVCERNFVKTYNHTISKRIVDFAKKNKCEFINLEQLTKDGFDNIILSNWSYYELQNMIKYKADREGIKVRYVNPAYTSQKCSKCGYIDKENRPTQEKFKCIKCGFELNADHNAAINISRLEE

SEQ ID NO: 272 - protein, 493 aa, Bacillus sp.
MITVRKLKLAIVSGNENETYQFLRNEMRNQYKALNISYSHLYFEYIAQEKIKHSNEEYQQHLTKYTEKAQEKYQNYLKCKGKAEVFKDDQQLQKRVEKARDDYNKAQEKVYKIEKQYSKKASEIYQKAVGLVKQTRIGKLINSKFDLHYDTVDRITSTVISHFTCDMKAGLLNGKRNLRNYKETNPLMIRARSMVLYEESGDYFIKWIKGITFKVILLESSKQRANINELKSLLVNIIEGNYKICDSSIAINKKLILNLSLNIPVSRKNSFMKGRVVGLDLGLRIPAYVSINDKPYIRKSIGSIEDFLKVRTQIQSQRKRLQKALQSTRGGKGKNKKLQGLNRIKEKEKNFVNTYNHFISSKIVQFALKNQAGIIHMEYLEFDRMKNKSLLRNWSYYQLQQMIEYKAKREGIEVKYIDAHYTSQTCSKCNHYELGQREIQEKFSCKSCGFNANADYNASQNIANSIKFITTNKKIIEELEVEEKQLSLDFNGS

SEQ ID NO: 273 - protein, 421 aa, Clostridioides difficile
MLYLPKYAIILLTCRIRMVAMIAVKKLKLTIVEEEEKRKEQYKFIRDSQYAQYQGLNLAMGILTSAYLVSGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKKVDEIVKDRVCGVDMGIAIPIYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHADKENRETQAKFKCLECGFEANADYNAARNIAKSDKFVK

SEQ ID NO: 274 - protein, 421 aa, Clostridioides difficile
MLYLPKYAIILLTCRIRMVAMIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKQVDEIVKGRVCGVDMGIAIPVYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPSYTSQTCSECGHVDKENRETQAKFKCLECGFEANADYNAARNIAKSDKFVK

SEQ ID NO: 275 - protein, 507 aa, Unknown
  uncultured archaeon
MEEAKTVSKTLSLRILRPLYSAEIEKEIKEEKERRKQGGKSGELDSGFYKKLEKKHTQMFGWDKLNLMLSQLQRQIARVFNQSISELYIETVIQGKKSNKHYTSKIVYNRAYSVFYNAYLALGITSKVEANFRSTELLMQKSSLPTAKSDNFPILLHKQKGVEGEEGGFKISADGNDLIFEIPIPFYEYDSANKKEPFKWIKKGGQKPTIKLILSTFRRQRNKGWAKDEGTDAEIRKVIEGKYQVSHIEINRGKKLGDHQKWFVNFTIEQPIYERKLDKNIIGGIDVGIKSPLVCAVNNSFARYSVDSNDVLKFSKQAFAFRRRLLSKNSLKRSGHGSKNKLDPITRMTEKNDRFRKKIIERWAKEVTNFFIKNQVGTVQIEDLSTMKDRQDNFFNQYLRGFWPYYQMQNLIENKLKEYGIETKRIKARYTSQLCSNPSCRHWNSYFSFDHRKTNNFPKFKCEKCALEISADYNAARNISTPDIEKFVAKATKGINLPDKNENVILE

SEQ ID NO: 276 - protein, 541 aa, Unknown
  uncultured archaeon
MWTIVIGDFIEMPKQDLVTTGIKFKLDVDKETRKKLDDYFDEYGKAINFAVKIIQKNLKEDRFAGKIALGEDKKPLLDKDGKKIYNYPNESCSCGNQVRRYVNAKPFCVDCYKLKFTENGIRKRMYSARGRKADSDINIKNSTNKISKTHFNYAIREGFILDKSLKKQRSKRIKKLLELKRKLQEFIDIRQGQMVLCPKIKNQRVDKFIHPSWLKRDKKLEEFRGYSLSVVEGKIKIFNRNILREEDSLRQRGHVNFKANRIMLDKSVRFLDGGKVNFNLNKGLPKEYLLDLPKKENKLSWLNEKISLIKLQKPKYAYLLRREGSFFIQYTIENVPKTFSDYLGAIGIDRGISHIAVCTFVSKNGVNKAPVFFSSGEILKLKSLQKQRDLFLRGKHNKIRKKSNMRNIDNKINLILHKYSRNIVNLAKSEKAFIVFEKLEKIKKSRFKMSKSLQYKLSQFTFKKLSDLVEYKAKIEGIKVDYVPPEYTSKECSHCGEKVDTQRPFNGNSSLFKCNKCRVQLNADYNASINIAKKSLNISNN

SEQ ID NO: 277 - protein, 537 aa, Unknown
  uncultured archaeon
MEESIITGVKFKLRIDKETTKKLNEYFDEYGKAINFAVKIIQKELADDRFAGKAKLDQNKNPILDENGKKIYEFPDEFCSCGKQVNKYVNNKPFCQECYKIRFTENGIRKRMYSAKGRKAEHKINILNSTNKISKTHFNYAIREAFILDKSIKKQRKKRNERLRESKKRLQQFIDMRDGKREICPTIKGQKVDRFIHPSWITKDKKLEDFRGYTLSIINSKIKILDRNIKREEKSLKEKGQIIFKAKRLMLDKSIRFVGDRKVLFTISKTLPKEYELDLPSKEKRLNWLKEKIEIIKNQKPKYAYLLRKNIESEKKPNYEYYLQYTLEIKPELKDFYDGAIGIDRGINHIAVCTFISNDGKVTPPKFFSSGEILRLKNLQKERDRFLLRKHNKNRKKGNMRVIENKINLILHRYSKQIVDMAKKLNASIVFEELGRIGKSRTKMKKSQRYKLSLFIFKKLSDLVDYKSRREGIRVTYVPPEYTSKECSHCGEKVNTQRPFNGNYSLFKCNKCGIQLNSDYNASINIAKKGLKIPNST

SEQ ID NO: 278 - protein, 534 aa, Unknown
  uncultured archaeon
MKLSEQENITTGVKFKLKLDKETSEGLNDYFDEYGKAINFAIKVIQKELAEDRFAGKVRLDENKKPLLNEDGKKIWDFPNEFCSCGKQVNRYVNGKSLCQECYKNKFTEYGIRKRMYSAKGRKAEQDINIKNSTNKISKTHFNYAIREAFILDKSIKKQRKERFRRLREMKKKLQEFIEIRDGNKILCPKIEKQRVERYIHPSWINKEKKLEDFRGYSMSNVLGKIKILDRNIKREEKSLKEKGQINFKARRLMLDKSVKFLNDNKISFTISKNLPKEYELDLPEKEKRLNWLKEKIKIIKNQKPKYAYLLRKDDNFYLQYTLETEFNLKEDYSGIVGIDRGVSHIAVYTFVHNNGKNERPLFLNSSEILRLKNLQKERDRFLRRKHNKKRKKSNMRNIEKKIQLILHNYSKQIVDFAKNKNAFIVFEKLEKPKKNRSKMSKKSQYKLSQFTFKKLSDLVDYKAKREGIKVLYISPEYTSKECSHCGEKVNTQRPFNGNSSLFKCNKCGVELNADYNASINIAKKGLNILNSTN

SEQ ID NO: 279 - protein, 726 aa, Unknown
  uncultured archaeon
MERQKVPQIRKIVRVVPLRILRPKYSDVIENALKKFKEKGDDTNTNDFWRAIRDRDTEFFRKELNFSEDEINQLERDTLFRVGLDNRVLFSYFDFLQEKLMKDYNKIISKLFINRQSKSSFENDLTDEEVEELIEKDVTPFYGAYIGKGIKSVIKSNLGGKFIKSVKIDRETKKVTKLTAINIGLMGLPVAKSDTFPIKIIKTNPDYITFQKSTKENLQKIEDYETGIEYGDLLVQITIPWFKNENKDFSLIKTKEAIEYYKLNGVGKKDLLNINLVLTTYHIRKKKSWQIDGSSQSLVREMANGELEEKWKSFFDTFIKKYGDEGKSALVKRRVNKKSRAKGEKGRELNLDERIKRLYDSIKAKSFPSEINLIPENYKWKLHFSIEIPPMVNDIDSNLYGGIDFGEQNIATLCVKNIEKDDYDFLTIYGNDLLKHAQASYARRRIMRVQDEYKARGHGKSRKTKAQEDYSERMQKLRQKITERLVKQISDFFLWRNKFHMAVCSLRYEDLNTLYKGESVKAKRMRQFINKQQLFNGIERKLKDYNSEIYVNSRYPHYTSRLCSKCGKLNLYFDFLKFRTKNIIIRKNPDGSEIKYMPFFICEFCGWKQAGDKNASANIADKDYQDKLNKEKEFCNIRKPKSKKEDIGEENEEERDYSRRFNRNSFIYNSLKKDNKLNQEKLFDEWKNQLKRKIDGRNKFEPKEYKDRFSYLFAYYQEIIKNESES

SEQ ID NO: 280 - protein, 777 aa, Unknown
  uncultured archaeon
MVTRAIKLKLDPTKNQYKLLNEMFWKWASLANRFSQKGASKETLAPKDGTQKIQFNATQLNQIKKDVDDLRGAMEKQGKQKERLLIQIQERLLTISEILRDDSKKEKDPHRPQNFRPFGWRRFHTSAYWSSEASKLTRQVDRVRRTIERIKAGKINFKPKRIGLWSSTYKINFLKKKINISPLKSKSFELDLITEPQQKIIGKEGGKSVANSKKYLDDSIKSLLIFAIKSRLFGLNNKDKPLFENIITPNLVRYHKKGQEQENFKKEVIKKFENKLKKEISQKQKEIIFSQIERQYENRDATFSEDYLRAISEFSEIFNQRKKERAKELLNSFNEKIRQLKKEVNGNISEEDLKILEVEAEKAYNYENGFIEWEYSEQFLGVLEKIARAVLISDNYFDLKKYPILIRKPTNKSKKITNLKPEEWDYYIQFGYGLINSPMKIETKNFMGIDRGLTHLLAYSIFDRDSEKFTINQLELNPIKGWKWKLRKVKRSLQHLERRMRAQKGVKLPENQMKKRLKSIEPKIESYYHNLSRKIVNLAKANNASIVVESLEGGGLKQHGRKKNSRHRALNYALSLFDYGKIASLIKYKSDLEGVPMYEVLPAYTSQQCAKCVLKKGSFVEPEIIGYIEEIGFKENLLTLLFEDTGLSSVQVLKKSKNKMTLSARDKEGKMVDLVLKYNFKGLVISQEKKKEEIVEFPIKEIDGKFAVLDSAYKRGKERISKKGNQKLVYTGNKKVGYCSVHGQVDADLNASRVIALCKYLGINEPIVFGEQRKSFK

SEQ ID NO: 281 - protein, 610 aa, Unknown
  uncultured archaeon
MDLITEPIQPHKSSSLRSKEFLEYQISDFLNFSLHSLFFGLASNEGPLVDFKIYDKIVIPKPEERFPKKESEEGKKLDSFDKRVEEYYSDKLEKKIERKLNTEEKNVIDREKTRIWGEVNKLEEIRSIIDEINEIKKQKHISEKSKLLGEKWKKVNNIQETLLSQEYVSLISNLSDELTNKKKELLAKKYSKFDDKIKKIKEDYGLEFDENTIKKEGEKAFLNPDKFSKYQFSSSYLKLIGEIARSLITYKGFLDLNKYPIIFRKPINKVKKIHNLEPDEWKYYIQFGYEQINNPKLETENILGIDRGLTHILAYSVFEPRSSKFILNKLEPNPIEGWKWKLRKLRRSIQNLERRWRAQDNVKLPENQMKKNLRSIEDKVENLYHNLSRKIVDLAKEKNACIVFEKLEGQGMKQHGRKKSDRLRGLNYKLSLFDYGKIAKLIKYKAEIEGIPIYRIDSAYTSQNCAKCVLESRRFAQPEEISCLDDFKEGDNLDKRILEGTGLVEAKIYKKLLKEKKEDFEIEEDIAMFDTKKVIKENKEKTVILDYVYTRRKEIIGTNHKKNIKGIAKYTGNTKIGYCMKHGQVDADLNASRTIALCKNFDINNPEIWK

SEQ ID NO: 282 - protein, 564 aa, Unknown
  uncultured archaeon
MARAKNQPYQKLTTTTGIKFKLDLSEEEGKRFDEYFSEYAKAVNFCAKVIYQLRKNLKFAGKKELAAKEWKFEISNCDFCNKQKEIYYKNIANGQKVCKGCHRTNFSDNAIRKKMIPVKGRKVESKFNIHNTTKKISGTHRHWAFEDAADIIESMDKQRKEKQKRLRREKRKLSYFFELFGDPAKRYELPKVGKQRVPRYLHKIIDKDSLTKKRGYSLSYIKNKIKISERNIERDEKSLRKASPIAFGARKIKMSKLDPKRAFDLENNVFKIPGKVIKGQYKFFGTNVANEHGKKFYKDRISKILAGKPKYFYLLRKKVAESDGNPIFEYYVQWSIDTETPAITSYDNILGIDAGITNLATTVLIPKNLSAEHCSHCGNNHVKPIFTKFFSGKELKAIKIKSRKQKYFLRGKHNKLVKIKRIRPIEQKVDGYCHVVSKQIVEMAKERNSCIALEKLEKPKKSKFRQRRREKYAVSMFVFKKLATFIKYKAAREGIEIIPVEPEGTSYTCSHCKNAQNNQRPYFKPNSKKSWTSMFKCGKCGIELNSDYNAAFNIAQKALNMTSA

SEQ ID NO: 283 - protein, 610 aa, Unknown
  uncultured archaeon
MDEKHFFCSYCNKELKISKNLINKISKGSIREDEAVSKAISIHNKKEHSLILGIKFKLFIENKLDKKKLNEYFDNYSKAVTFAARIFDKIRSPYKFIGLKDKNTKKWTFPKAKCVFCLEEKEVAYANEKDNSKICTECYLKEFGENGIRKKIYSTRGRKVEPKYNIFNSTKELSSTHYNYAIRDAFQLLDALKKQRQKKLKSIFNQKLRLKEFEDIFSDPQKRIELSLKPHQREKRYIHLSKSGQESINRGYTLRFVRGKIKSLTRNIEREEKSLRKKTPIHFKGNRLMIFPAGIKFDFASNKVKISISKNLPNEFNFSGTNVKNEHGKSFFKSRIELIKTQKPKYAYVLRKIKREYSKLRNYEIEKIRLENPNADLCDFYLQYTIETESRNNEEINGIIGIDRGITNLACLVLLKKGDKKPSGVKFYKGNKILGMKIAYRKHLYLLKGKRNKLRKQRQIRAIEPKINLILHQISKDIVKIAKEKNFAIALEQLEKPKKARFAQRKKEKYKLALFTFKNLSTLIEYKSKREGIPVIYVPPEKTSQMCSHCAINGDEHVDTQRPYKKPNAQKPSYSLFKCNKCGIELNADYNAAFNIAQKGLKTLMLNHSH

SEQ ID NO: 284 - protein, 327 aa, Clostridioides difficile
MVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNNDVILNLVIDIPQNSNVYKPVEGRTLGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQAKFKCTKCGFELNADHNAAINIARSIEFV

SEQ ID NO: 285 - protein, 364 aa, Desulfovibrio fructosivorans
MATLERNFAVKTYRNTNKDAWAGRKSLPTYRSLFVPFRHTGTKIAVVERNGTKQFCIDPQGFGASWLSDELIAEVHDGPIAIEKQRRKLTLVSCFSWRDQGAVEIVQRIVNGEYKLSDGQIQMGKKGLVALLPYSFDAIQPELDPARVCGIDLGAVIPAVCAVNFGPQRAYLGEGKDVWAARSRFRAERRRLQSRAGLYSKTKNWRRSEKEDNWIQTYYHALTRKVIKFCVQHGCGTIHMEDLSSLRQRDVESEFRRLLWVPSKFFELLSYKAKEMGIGIVKINPRNTSKRCSECGHISKGNRKSQEKFVCEKCGEGKRPVNADYNAARNIALATGDVLLHGYIESEPDALGEMDQLWEGAQEA

SEQ ID NO: 286 - protein, 366 aa, Clostridium botulinum
MDIQKEFKEKYVDDLYQVLDKIPFKHLDNKSLVTQRIKADIKSDKSNGLLKGERSIRNYKRNFPLMTRGRDLKFKYDDNDDIEIKWMEGIKFKVILGNRIKNSLELRHTLHKVIEGKYKICDSSLQFDKNNNLILNLTLDIPIDIVNKKVSGRVVGVDLGLKIPAYCALNDVEYIKKSIGRIDDFLKVRTQMQSRRRRLQIAIQSAKGGKGRVNKLQALERFAEKEKNFAKTYNHFLSSNIVKFAVSNQAEQINMELLSLKETQNKSILRNWSYYQLQTMIEYKAQREGIKVKYIDPYHTSQTCSKCGNYEEGQRESQADFICKKCGYKVNADYNAARNIAMSNKYITKKKKVSITKLKKVWYNKT

SEQ ID NO: 287 - protein, 401 aa, Clostridioides difficile
MIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDNEFYIKWVNKIVFKVLIGRKDKNKVELIHTLNKVLNKEYKVSQSSLQFDKNNKLILNLTIDIPYKQVDEIVKDRTCGVDMGIAIPIYVALNDVSYVREGMGTIDEFMKQRLQFQSRRRRLQQQLKNVNGGKGRKDKLKGLELLREKEKSWVKTYNHALSKRVVEFAKKNKCEYIHLEKLTKDGFGDRLLRNWSYYELQEMIKYKGERVGIKVKYVNPAYTSQTCSECGHVDKENRETQAKFKCLECGFEANADYNAARNIAKSDKFVK

SEQ ID NO: 288 - protein, 401 aa, Clostridioides difficile
MIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKQVDEIVKGRVCGVDMGIAIPVYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHVDKENRETQAKFKCLECGFEANADYNAARNIAKSDKFVK

SEQ ID NO: 289 - protein, 401 aa, Clostridioides difficile
MIAVKKLKLTIVEEEEKRKEQYKFIRDSQYAQYQGLNLAMGILTSAYLVSGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKKVDEIVKDRVCGVDMGIAIPIYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHADKENRETQAKFKCLECGFEANADYNAARNIAKSDKFVK

SEQ ID NO: 290 - protein, 401 aa, Clostridioides difficile
MIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKQVDEIVKGRVCGVDMGIAIPVYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPSYTSQTCSECGHVDKENRETQAKFKCLECGFEANADYNAARNIAKSDKFVK

SEQ ID NO: 291 - protein, 401 aa, Clostridioides difficile
MIAVKKLKLTIVEEEEKRKEQYKFIRDSQYAQYQGLNLAMGILTSAYLASGRDIKSNLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKKVDEIVKDRVCGVDMGIAIPIYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKSDRVGIKVKYVNPAYTSQTCSECSHVDKENRETQSKFKCLECGFEANADYNAARNIAKSDKFVK

SEQ ID NO: 292 - protein, 404 aa, Clostridioides difficile
MVAMIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKQVDEIVKGRVCGVDMGIAIPVYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHVDKENRETQAKFKCLECGFEANADYNAARNIAKSDKFVK

SEQ ID NO: 293 - protein, 404 aa, Clostridioides difficile
MVAMIAVKKLKLTIVEEEEKRKEQYKFIRDSQYAQYQGLNLAMGILTSAYLVSGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKKVDEIVKDRVCGVDMGIAIPIYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHADKENRETQAKFKCLECGFEANADYNAARNIAKSDKFVK

SEQ ID NO: 294 - protein, 404 aa, Clostridioides difficile
MVAMIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDNEFYIKWVNKIVFKVLIGRKDKNKVELIHTLNKVLNKEYKVSQSSLQFDKNNKLILNLTIDIPYKQVDEIVKDRTCGVDMGIAIPIYVALNDVSYVREGMGTIDEFMKQRLQFQSRRRRLQQQLKNVNGGKGRKDKLKGLELLREKEKSWVKTYNHALSKRVVEFAKKNKCEYIHLEKLTKDGFGDRLLRNWSYYELQEMIKYKGERVGIKVKYVNPAYTSQTCSECGHVDKENRETQAKFKCLECGFEANADYNAARNIAKSDKFVK

SEQ ID NO: 295 - protein, 404 aa, Clostridioides difficile
MVAMIAVKKLKLTIVEEEEKRKEQYKFIRDSQYAQYQGLNLAMGILTSAYLASGRDIKSDLFKYSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPCKKVDEIVKDRVCGVDMGIAIPVYVALNDISYVREGMGTIDEFMKQRLQFQSRRRRLQQQLKNVTGGKGRKDKLKGLELLREKEKSWVKTYNHALSKRVVEFAKKNKCEYIHLEKLTKDGFGDRLLRNWSYYELQEMIKYKGERVGIKVKYVNPAYTSQTCSECGHVDKENRETQAKFKCLECRFEANADYNAARNIGKSDKFVK

SEQ ID NO: 296 - protein, 404 aa, Clostridioides difficile
MVAMIAVKKLKLTIVGEEEKRKEQYKFIRDSQYAQYQGLNLAMGILTSAYLASGRDINSDLFKDSKKSLTNSNEIFNGINFGKGIDTKSSITPKVRNDFFTSLKNGLAKGERSFTNYKRDFPLMTRGRDLKFYEEDKEFYIKWVNKVVFKVPIGRKDKNKVELVHTLNKVLNKEYKVSQSSLQFDKNNKLILNLTIDIPYKKIDEIVKGRVCGVDMGIAIPVYVALNNVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKGERVGIKVKYVNPAYTSQTCSECGHVDKENRETQAKFKCLECGFEANADYNAARNIAKSDKFVK

SEQ ID NO: 297 - protein, 407 aa, Clostridium hiranonis
MGSKFMITVRKLKLTIINDDETKRNEQYKFIRDSQYAQYQGLNLAMSVLTNAYLSSNRDIKSDLFKETQKNLKNSSHIFDDITFGKGTDNKSLINQKVKKDFNSAIKNGLARGERNITNYKRTFPLMTRGTALKFSYKDDCSDEIIIKWVNKIVFKVVIGRKDKNYLELMHTLNKVINGEYKVGQSSIYFDKSNKLILNLTLYIPEKKDDDAINGRTLGVDLGIKYPAYVCLNDDTFIRQHIGESLELSKQREQFRNRRKRLQQQLKNVKGGKGREKKLAALDKVAVCERNFVKTYNHTISKRIIDFAKKNKCEFINLEQLTKDGFDNIILSNWSYYELQNMIKYKADREGIKVRYVNPAYTSQKCSKCGYIDKENRPTQEKFKCIKCGFELNADHNAAINISRLEE

SEQ ID NO: 298 - protein, 421 aa, Clostridioides difficile
MLYLPKYAIILLTCRIRMVAMIAVKKLKLTIVEEEEKRKEQYKFIRDSQYAQYQGLNLAMGILTSAYLASGRDIKSDLFKDSQKSLTNSNEIFNGINFGKGIDTKSSITQKVKKDFSTSLKNGLAKGERGFTNYKRDFPLMTRGRDLKFYEEDKEFYIKWVNKIVFKILIGRKDKNKVELIHTLNKVLNKEYKVSQSSLQFDKNNKLILNLTIDIPYKQVDEIVKGRVCGVDMGIAIPVYVALNDVSYVREGMGTIDEFMKQRLQFQSRRRRLQQQLKNVNGGKGRKDKLKGLESLREKEKSWVKTYNHALSKRVVEFAKKNKCEYIHLEKLTKDGFGDRLLRNWSYYELQEMIKYKADRVGIKVKHVNPAYTSQTCSECGHVDKENRETQAKFKCLECGFEANADYNAARNIAKSDKFVK

SEQ ID NO: 299 - protein, 422 aa, Aneurinibacillus danicus
MKHTKVMRYQIIKPINDTWETLGHVLREIQRETRAALNKTIQLAWEWQGFSAEYKQRYEEYPKTKDHLGYSALHGYAYNRLKDEFYRMNTANLSQTVKRAADKWKSDLKDVLRGDKSIASFKKDCPIDIVSQALRIRKDGSDYIMTLSLVSIKYRKELERKQSFFDVLISANDKTQRDILDRLIAGEYKLGASQLLYHKKKWFVNVNYQFEKEETAFDQDNIMGVDLGIVYPVYMAFNNSLNRYKIEGGEIERFRAQVERRKKQLLQQAKYCGDGRRGHGTKTRIQPIEVVSDKVANFRDTVNHRYSRYVVDMAIKHRCGTIQMEDLSGIAAEDTFLKRWSYYDLQQKIEYKAKEAGIQVVYIKPDYTSQRCSKCGHIERDNRTEQATFECKSCGFKTNADFNAARNIATKDIEKIIAETLK

SEQ ID NO: 300 - protein, 424 aa, Parageobacillus thermoglucosidasius
MKYTKVMRYQIIKPLNAEWDELGMVLRDIQKETRAALNKTIQLCWEYQGFSADYKQIHGQYPKLKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVDLGIVYPVYIAFNNSLHRYHIKGGEIERFRRQVEKRKRELLNQGKYCGDGRKGHGYATRTKSIESISDKIARFRDTCNHKYSRFIVDMALKHKCGIIQMEDLTGISKESTFLKNWTYYDLQQKIEYKAREAGIQVIKIEPQYTSQRCSKCGYIDKENRQEQATFKCIECGFETNADYNAARNIAIPNIDKIIRKTLKMQ

SEQ ID NO: 301 - protein, 427 aa, Brevibacillus centrosporus
MLTKVMRYQIIKPLDDDWDVLGQVLRTVQRETHALLNKTIQLAWEWQGFSSEYKEKYGLYPIQQEILPKKKGGNVGSIMHYAYDQLKDIYTVSDRRNLNQSIKRATDKWKSDVPDIRKGEKSIPSFKKDCPIDVVSQAYSLHRGSEGFVMRAGLMSTEYKKELGRRFGSFDLLLNVKDNTQRTIIERLISGEYKAGVAQILRHKKDWFVNLTYSFEHVDSLLNPDRIMGVDLGIVYPVYLAFNDLFERYKIDGGEIESFRKQVERRRKQQNWQGKYCGDGRIGHGTHTRIKPTEVTEERIANFRDSCNHKYSRFVVEIALKHRCGTIQMEDLSGYSKATDDAFLKNWAYHDLQQKIEYKAKEVGIKVVKVKPECTSQRCSKCGHIAKENRQDREFLCKGCGFQVHADYNAARNIATKDIEEIIKQAL

SEQ ID NO: 302 - protein, 428 aa, Clostridium pasteurianum
MNKCIKITIKNCNQLNFTNINKTLSNIRYMTCKASNKAMQMYYMWEYERMNYKKLNGQYPIDKDLFGKTYRNVVEGYMKEIMNIVNTSNVSQTNAFVLKKWNSDKQDILNYRKSVASFKLNMPIYIYNKNYKIIQGNNGYEIDAAIFNKKQDLRHVTFNIDKLDNNKKVTLNKIISGIYKQGAAQIIQDKKGKWYFIISFSFVPDIKELDKNRILGVDLGITNTATLQIWDNNEKKWDKLLYRECILDGKESIHFRQKVEARRRSMLISCKVAGDGRSGHGTKTKIRSASNIGDKINNFRDTLNHKYSKYIVDFAVKHNCGTVQLEDLTGFNPENNFLKSWPYFDMQSKIKYKSKEKGIDIKIINPYKTSQRCSICGCIDKLNRDSKNNQSIFKCINCGYEEHADINAAKNIALPNIEKLIKNFAKIP

SEQ ID NO: 303 - protein, 433 aa, Eubacterium siraeum
MVCNKVVKIALICDQIDKDGKDVNYNDIYKLLWDLQKQTREAKNKVIRLCWEWSGYSSEYFKTHEEYPKDKEIFGISLRGYLYDRIKGDYNLYSGNLSQSAEIAYKEYKNSLKDVLRGDKSIINYRENQPLDIKNKAIQLLYENDNFFVRVALINKDKQKELNFKDCSVRFKLLVKDDSTRTILERCFDEVYTITASKIMYNKKKKQWYINLGYKFTKEIDKTLDKDRILGVDLGVINPLVASVYGSYDRLIIGGGEIDKFRKRVEANKVQMLKQGKYCGDGRIGHGVNTRNKPAYNIEDKISRFRDTVNHKYSKAVVDYAVKNNCGTIQMEDLKGITQNKNERYLKNWTYFDLQTKIEYKAKALGIEVKYKNPKYTSQRCSKCGHIAEENRPEQKTFKCVKCGFKVNADYNASQNLAIKDIDKIIEQYYNKG

SEQ ID NO: 304 - protein, 438 aa, Bacillus toyonensis
MKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 305 - protein, 439 aa, Ruminococcus sp.
MSKDKYVITRKIKLLPVGDKDEVDRVYDFIRDGQYSQYNALNILMGQLASKYYECKRDLSSAEFKEAQKSILSNSNPNLCDIEFAKGCDTKSAVVQKVKQDFSIAIKNGLPRGERNITNYKRTVPLITRGRDLVFIHGYENYTEFLDNLYTDRNLKVFIKWINKIQFKIVFGNPYKSAELRNVVQNIFEERYKVNGSSIKIDDGDIILNLSLTMPKEIKELDENKVVGVDLGLAIPAVCALNTNGYSRKSIGNANDFSRVRTKIKAQRRRLQKSLSQTSGGHGRGKKLRALNRFSEYEKHWVQNYSHYVSKQVVDFAIKNNAKYINLEDLEGYGDDEKNKFILSNWSYYQVQQYITYKAEKYGIEVRKINPYRTSQVCSCCGHWENGQRIDQATFICKNPECKNFGEKVNADFNAARNIALSTDWSDIDEKKNKKNKKK

SEQ ID NO: 306 - protein, 440 aa, Ruminococcus sp.
MVKVVKIYLISEQFDKAGNRIDYKEVNKILWELQKQTREAKNKTVQLLWEWNNFSSDYVKASGIYPKAKDIFGYSSVHGQANKELRTKLILNSSNLSTTTMDVCKIFNTYKKEVWEGKRSVPSYKSDQPLDLHKDSIKLIYENNQFYVRLALLKKAEFAKYGFKDGFRFKMQVKDNSTKTILERCFDEVYKINASKLLYDQKKKMWKLNLSYSFDNKNISELDKEKILGVDVGVNCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIENKAKEVGINVVYIAPKYTSQRCSKCGYIHKDNRPNQAKFRCLKCDFESNADYNASQNIGIKNIAKIIEKDLKKQKSEVQVNENK

SEQ ID NO: 307 - protein, 441 aa, Clostridium perfringens
MSTKCVKIALEYSKDNVLKKEEFLKELKDIQYKTWLASNRAITYFYSNDMQNLIQKDIGIPKEDDKKLFGKGFGSWVENRMNEIMYGALSNNVAQTRQFVNNRYSQDKKNGLLKGNISLSQFKRDMPIIIHNKAYNIINTPKGLGIEIGFFNKEKQQKLGVKRIKFLFPKLDNSSKQILIRLMDKTYKQGSIQIVNNKRKKKWLVAISYTFENKLQKPLSDNLVMGIDLGITNVATMSIFNTKKEEYKAMYWKERIIDGTELIHYRQKIEARRKSLSIASKWSSDSAIGHGYKRRMKKANSVGDKYNRFKDTYNHKVSRYIVDLAYKYGVKTIQMEDLSGFSEYQSESLLKNWSYYDLQNKIKYKAEEKGINTIFINPQYTSKRCSKCGNIHEDNRDCKNNQAEFKCVICKYSENADINASKNIAIPYIDKIISEYIKDIK

SEQ ID NO: 308 - protein, 443 aa, Bacillus thuringiensis
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGMKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 309 - protein, 444 aa, Clostridium perfringens
MTTKSIKLAIEFSKENCVDKKKFFDNIKDIQYKTWKASNRAITYLYSNDMQNLIQKDVGLPKQEDKDIFGKSFGAWIENKMNEIIDGANSGNVAQQRAFVINRYNQDKKNGLLEGKVTLTQFKRNIPIIIHNKSYKIIETNKGLGVEVGLFNKKLQKELDVKRIKFLFPKINNSSKSILRRLMDGTYKQGTIQMKHDARKNKWFMSITFTFDNKIDKTLDENLVMGIDLGISKVATMSIYNIEKHEYKEMYWKERTIDGAELIHYRQKLEARRKALMISSKWSSNNAIGHGYKRRTVKANELGEKYTRFRDTYNHKISRYIVDLAFKYGVKTIQMENLSGFSTEQSESLLKNWSYYDLQSKIEYKSKDKGINVVFINPKFTSKRCNRCGNIRSENRSCKNDQAKFKCVVCGHEDNADINASKNIAIPYIDKIIDEYLKEKEEVI

SEQ ID NO: 310 - protein, 445 aa, Bacillus cereus
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 311 - protein, 445 aa, Bacillus toyonensis
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 312 - protein, 445 aa, Bacillus toyonensis
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQVEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 313 - protein, 445 aa, Bacillus toyonensis
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYTNYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 314 - protein, 447 aa, Alicyclobacillus acidoterrestris
MIVKTMPYEIIKPLSCDWAVFGEMLRRLRDESFRIKNSAIQYFYEDDIKRREFKKNNGRFPKKGEFYGSSVSVYNYVRPDVKYSAMGNVTLINQLVKSVWIKYKDDVVKRNMSIPSYRPNNPIEINVQSFNSFDFGQACVNLLSRKGVEELKKKLSEVKKKKNKTGGDDNLKFTQEQLNGISTSVTFAFNPGKNNAKQVLNRIISGEYKLSSSKIIYNERKNKWMLAVAYKFEPKTIELDKNRVLGIDMGVVYPAYMAVNYDKYWRDSIDGGQIEQYRKTVEARRRRLQRQAAVCGNGRIGHGRKKRMQPLEKISDKVANFRNTVNHTYAKKIVQNAVKLGCGTIQMEELSGINEKETFLKRWTYFDLQKKIEYRAKEYGIDVIKINPKYTSQRCSECGYIDERNRPKVPDQSKFKCLSCGYETNADFNAARNIATPYIDKIISLNS

SEQ ID NO: 315 - protein, 447 aa, Clostridium tetani
MNKCIKVELKSCLEKNLSNKQSQKFLKDIQYLSWKGCNRAITYLYNHDMKNSELKYKNLPKIDPNKEYGKSLGSWIEDKLKEIMVGCLTTNVAQTRAFVMNRYKQDKKQGLLKGNVSLSNFKRNMPIIIHNKAYKIIKDDKGYIAEIGLFNLIKQKELGIKRLTFRINKLDGNKKSTLNKIINEDYKLGSGQIKQDSKGKWYLLISYSFKNEIVEGLDKDKILGIDLGIVNTVAMSIYNIKKDTWEQTRYKDTVIDGEELIHFRKKIEARKKSLSIGSKYCGDGRIGHGYKTRMKPFLNIKDKISKFRDTYNHKISRYIIDFAIKNKCGAIQMEDLSGFPEYQTEKFLKDWTYYDLQNKLKYKAEEIGIDIIFINPKYTSQRCSKCGNINNKNRDCKKDQAKFQCIICGYKENADINASKNISIPYIDDIIKEYLKENNSIKVDFPT

SEQ ID NO: 316 - protein, 449 aa, Candidatus Levybacteria bacterium
MVREIRKLNVIDKVEKKKVVQRTLRLKLELVDKGSKDRIDKIVRDCPYAANGIINGQWFNDYEADALRYRVIGNVNFKELTDCEKEEYKNKLSSCEDILIQKYGTKRQATTERDIKNLFPEIPPCVTNPLNNKIVSTYNKVKGDIKKGNRVLSTFKKDMPIPTTLSSVVFGEDKGKFFIVWSLSRSEKIKFKIKLGKDKSGYKQDLVAIINKTKNICAPEFQYKKRNFYLLLPVKDEVNPHSHLFNDRVVGIDLGLNIPAYASCISNGSEFVDSEHFGSKESFLKVRLQFRNRKRQLQKDLQYVNGGKGRRKKTKALDEYEFKERNYCRTYNHNLTSKIIDFAIKCGAKHINLESLKGFREKKILGFWSYFEMQTLLEYKAKRNNIEVHFVSANYTSQTCSQCGNCDKTQRKGVNFTCNKCGYVEDADFNASINIAKSIQFVANKKASK

SEQ ID NO: 317 - protein, 450 aa, Bacillus cereus
MSTVVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGGISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 318 - protein, 450 aa, Bacillus cereus
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNLANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 319 - protein, 450 aa, Bacillus cereus
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKFNCGTIQLEDLQGISKEQTFLKNWTYFDLQEKIKNQANQYGIKVVKIDPSYTSQRCSECGCIHKNNRQNQSTFECQQCSFKVHADYNAAKNISVYNIEKVIQKQLKLQEKLNLTKYKEQYIEQMENIN

SEQ ID NO: 320 - protein, 450 aa, Clostridium paraputrificum
MKLNKCIKVTLVKCLNYDYKEIKQIIRDFNYTACKASNKAMRMWFFHTQDMIDKKNKYKEFNQIQYEKDTYGKSYRNVIEGEMKKIMPLANTSNVGTLHQQLVQNDWSRLKKDILSCKANLPTYKLSTPYFIKNDNFKLRNHNGYFVDIAFFNKEGLKQYGYKAGHKFEFQIDKLDGNKKSTINKIINGEYKQGSAQLSISNKGKIELIISYSFEKEEVPVLDKNKILGIDLGITNVATMSVYDSMREQYDYFSWKTNVISGKELIAFRQKYYNLRRDMSIASKTAGQGRCGHGYKTKMKSVNKVRNKIANFADTYNHKISKYIIEFAIKNNCGVIQVEDLSGATADTHNKMLKDWSYYDLQQKIEYKAKEQGIEVIKVNPKYTSKRCSKCGCIHEDNRDCRNNQAKFECKVCGYNENADINASKNIAIPDIDNIIKGTEILHSKENKAS

SEQ ID NO: 321 - protein, 451 aa, Bacillus cereus
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 322 - protein, 451 aa, Bacillus thuringiensis
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENDDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKIFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKIAPAYTSQRCSQCGYICKENRCTQAVFECKQCGYKTHADYNAAKNISIYDIENIINKQLAVQSKLHSKKCMEEYIEELGYLD

SEQ ID NO: 323 - protein, 451 aa, Bacillus cereus
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 324 - protein, 451 aa, Bacillus toyonensis
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 325 - protein, 451 aa, Bacillus cereus
MGVTIKIMKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 326 - protein, 451 aa, Bacillus toyonensis
MGVTIKIMKYQILCPMNVDWIIFEKHLRNLTYQIRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKEKKFDKELIMGIDMGGINTVYFAFNEGFIRSNIKSDEIKEFNERIRQRRINLLNQSKYCSNSRTGKGRTKRLQPIDVLSNKIAKFRNSTNHKYANYIIKQCLKYNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAAQSKLHSKKCMEEYIEELGYLD

SEQ ID NO: 327 - protein, 451 aa, Bacillus wiedmannii
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGMSKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 328 - protein, 451 aa, Bacillus cereus
MGVTIKIMKYQILCPMNVDWTIFEKHLRNLTYQVRTISNRTIQQLWEFDALSFDYFKERGTYPSVQDLYGCTQKKIDGYIYHILQSKYPDIHKGNMSTTLQKIIKTWKSRRNEIRKGEMSIPSFRNRIPIDLHNNSVDITKEKNGDYIAGISLFSRDFHKENGDVPKGKIFVKLATQKQKSMKVILDRLMSQTYSKGACMIHKCKNKWYLSITYKFNAIKENKFDKDLIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKGNRCTQAIFECKQCGYKTNADYNAAKNIATYDIENIINKQLAAQSKLNSKKCMEEYIEELGYLD

SEQ ID NO: 329 - protein, 451 aa, Bacillus cereus
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVEITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 330 - protein, 451 aa, Bacillus toyonensis
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFLRDFHKENGDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKMFNERIRQRRINLLKQSKYCSNSRIGKGRTKRLQPIDVLSNKIAKFRNSTNHKYANYIVKQCLKHNCGRIQMELLKGISKNDKILKDWTYFDLQEKIKNQAGIHGIEVIKIAPAYTSQRCSQCGYICKENRCTQAVFECKQCGYKTHADYNAAKNISIYDIENIINKQLAVQSKLHSKKCMEEYIEELGYLD

SEQ ID NO: 331 - protein, 451 aa, Bacillus cereus
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENKFDKDLIMGIDMGGINTVYFAFNEGFIRSNIKSDEIKAFNERIRQRRINLLKQSKYCSNSRTGKGREKRLQPIDVLSNKIAKFRNSTNHKYANYIIKQCLKHNCGRIQMELLKGISKNDKVLKDWTYFDLQEKIQNQAEIHGIEVIKVAPAYTSQRCSQCGYICKENRCTQAVFECKQCGYKTHADYNAAKNIATYDIENIINKQLAVQSKLHSKKCMEEYIEELGYLD

SEQ ID NO: 332 - protein, 451 aa, Bacillus toyonensis
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWIYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 333 - protein, 451 aa, Bacillus thuringiensis
MRVTIKIMKYQILCPMNVDWTIFEKHLRNLTYQVRTISNRTIQQLWEFDALSFDYFKEKGTYPTVQDLYGCTQKKIDGYIYHTLQSKYLDIHKGNMSTTLQKIIKTWKSRRNEIRKGEMSIPSFRNRIPIDLHNNSVDITKEKNGDYIAGISLFSRDFHKENGDVPKGKIFVKLATQRQKSMKVILDRLINQTYSKGACMIHKYKNKWYLSITYKFNAIKENKFDKELIMGIDMGGINTVYFAFNEGFIRSNIKSDEIKAFNERIRQRRINLLKQSKYCSNSRTGKGREKRLQPIDVLSNKIAKFRNSTNHKYANYIIKQCLKHNCGRIQMELLKGISKNDKVLKDWTYFDLQEKIQNQAEIHGIEVIKVAPAYTSQRCSQCGYICKENRCTQAVFECKQCGYKTHADYNAAKNIATYDIENIINKQLAVQSKLHSKKCMEEYIEELGYLD

SEQ ID NO: 334 - protein, 451 aa, Bacillus cereus
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENGDVPKGKIFVKLATQKQKSMKVILDRLMNQTYSKGACMIHKYKNKWYLSITYKFNALKENKFDTELIMGIDMGGINTVYFAFNKGFIRSNIKSDEIKTFNERIRQRRINLLNQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQDMFECKQCGYKTHADYNAAKNISTYGIENIINKQLAVQSKLHSKKCMEEYIEKLGYLD

SEQ ID NO: 335 - protein, 451 aa, Bacillus cereus
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 336 - protein, 451 aa, Bacillus cereus
MGVTIKIMKYQILCPMNVDWTIFEKHLRNLTYQVRTISNRTIQQLWEFDALSFNYFKERGTYPTVQDLYGCTQKKIDGYIYHTLQSKYPDIHKGNMSSTLQKIIKTWKSRKNEIRKGEMSIPSFRNRIPIDLHNNSVDITKEKNGDYIAGISLFSRDFHKENGDVPKGKIFVKLATQKQKSMKVILNRLINQTYSKGACMIHKYKNKWYLSITYKFNVIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIVPAYTSQRCSQCGYICKENRCTQAMFECKQCGYKTHADYNAAKNISTYDIENIINKQLAVQSKLHSKKCMAEYMEELGYLD

SEQ ID NO: 337 - protein, 453 aa, Bacillus thuringiensis
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGMKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 338 - protein, 453 aa, Bacillus sp.
MTYLSTVVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGGISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 339 - protein, 453 aa, Bacillus cereus
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNLANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 340 - protein, 453 aa, Bacillus cereus
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKFNCGTIQLEDLQGISKEQTFLKNWTYFDLQEKIKNQANQYGIKVVKIDPSYTSQRCSECGCIHKNNRQNQSTFECQQCSFKVHADYNAAKNISVYNIEKVIQKQLKLQEKLNLTKYKEQYIEQMENIN

SEQ ID NO: 341 - protein, 453 aa, Bacillus thuringiensis
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQRQLKLQEKLNLTKYKEQYIEQMENIN

SEQ ID NO: 342 - protein, 453 aa, Bacillus sp.
MKYLSTVVKVMKYQIICPVNIEWKAFETYLRTLSYQVRTIGNRTIQKLWDFDNQSLNHFRENGVYPSAQQLYGCTQKTISGYIYDQLKEEYQDMNKANMSTTLQKTIKTWNSRKKEIRSGEMSIPSFRNNLPIDIHGNSIQITKEKSGDYIASLSLFSSNFIIENNLPNGKIQVKLSTRKQNSMKVILDRIIENTYAKGACMLHKHKNKWYLSIIYKPTVKEEHKFEEDLVMGIDMGKINVLYFAFNKGWIRGAISGEEIEAFRKKIEHRRISLLRQGKYCSGNRVGKGREKRIKPIDVLNNKIAKFRNATNHKYANYIVQQCLKYNCGTIQLENLQGISKEQTFLKNWTYFDLQEKIKQQAHQYGMKVVTIDPSYTSKRCSECGYIHKNNRKSQSTFECQQCNLKVHADYNAAKNISIYNIEKVIQKQLKLQEKLNSKKFTEQYIEQVENIN

SEQ ID NO: 343 - protein, 453 aa, Prevotella copri
MSKITRKIEIIPDVEGLTHEESNEKCYKAFYNYDRKLYKVANLLVSQLYGLDNLLSLMRLQNEEYVDSQRKLSFKSTTDTAKEEIKKRMEEIDAELMAIKKKIAPMHPQSYSYRAVNSSEYAKDMPSDIVDSLKQDVYKHFNDSKKEQIRGERSLTTYKRGMPIPFNLKKKHSIVCDGDNYYLPWFEDTRFRLNFGRDRSNNRAIIDNCIKTKKYKLCAAAKIQLKERKLFLLITVDIPKAESVPVKGKVMGVDLGVINPAYVAVNDGPERSRIGNGETFQKQRDVFRRRFRELQRSQLTQGGHGRKHKTKATEILRGKERNWVQTENHRISREIVNLASRWKVETIQMESLKGFGKNQEGEVEYNHKRLLGRWSYFELQKDIEYKAAMAGIAVQYVNPAYTSQTCHVCGQRGNRIERDTFICTNPECTCYNQAQDADMNAAINIAKSKDVIK

SEQ ID NO: 344 - protein, 453 aa, Prevotella copri
MSKITRKIEIIPDVEGLTHEESNEKCYKAFYNYDRKLYKVANLLVSQLYGLDNLLSLMRLQNEEYVDSQRKLSFKSTTDAAKEEIKKRMEEIDAELMAIKKKIAPMHPQSYSYRAVNSSEYAKDMPSDIVDSLKQDVYKHFNDSKKEQIRGERSLTTYKRGMPIPFNLKKKHSIVCDGGNYYLPWFEDTRFRLNFGRDRSNNRAIIDNCIKTKKYKLCAAAKIQLKERKLFLLITVDIPKAESVPVKGKVMGVDLGVVNPAYVAVNDGPERSRIGNGEAFQKQRDVFRRRFRELQRSQLTQSGHGRKHKTKATEILRGKERNWVQTENHRISREIVNLASRWKVETIQMESLKGFGKNQEGEVEYNHKRLLGRWSYFELQKDIEYKAAMAGIAVQYVNPAYTSQTCHVCGQRGNRIERDTFICTNPECTCYNQAQDADMNAAINIAKSKDVIK

SEQ ID NO: 345 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNNDVILNLVIDIPQNSNVYKPVEGRTLGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQAKFKCTKCGFELNADHNAAINIARSIEFV

SEQ ID NO: 346 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKVFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNKDVILNLVIDIPQNSNVYKPVEGRILGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQANFKCTKCGFELNADHNAAINIARSIEFV

SEQ ID NO: 347 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFAKNNKDIILNLVIDIPQNSNVYKPVEGRTLGVDLGIAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGIAVRYVNPAYTSQKCSRCGEIDKENRQTQANFKCTKCGFELNADHNAAINIARSIEFV

SEQ ID NO: 348 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFAKNNKDIILNLVIDIPQNSNVYKPVEGRTLGVDLGIAVPIYMCLNDDTYKRKGLSDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGIAVRYVNPAYTSQKCSRCGEIDKENRQTQANFKCTKCGFELNADHNAAINIARSIEFV

SEQ ID NO: 349 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNKDVILNLVIDIPQNSNVYKPVEDRTLGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQANFKCTKCGFELNADHNAAINIARSIEFV

SEQ ID NO: 350 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYVEDTFYLDIMCGYRLEVVLGKRDNENVNELKSTLEKVISKEYKVCDSSMQFSKNNKDVILNLVIDIPQNSNVYKPVEGRTLGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQANFKCTKCGFELNADHNAAINIARSIEFV

SEQ ID NO: 351 - protein, 461 aa, Clostridioides difficile
MISTRKIKVRCDDSTFYTFFRQEQREQNKALNIGIGIIHANAVLHNVDSGAEKKLKKSIEGLQGKIDKLNKDLEKEKITDKKKEEVLKAIETNKKILDGEKKAFKESEEYRKGIDELFKNTYLKSNTLDHVLDSMVNIQYKRTLSLVTQRIKKDYSNDFVGIITGQQSLRNYRNDNPLMISNQQLNFKYIDDTFYLDIMCGYRLEVVLGKRDNENVNELKSTLEKVISKEYKVCDSSMQFSKNNKDVILNLVIDIPQNSSVYKPVEGRTLGVDLGVAVPIYMCLNDDTYKRKGLGDINNFLRVRQQMQTRRRKLQKDLTLTNGGKGRKKKTQLLDKLQENERNFVKTYSHALSKRVVEFAKSNKCEYINIEKLTKDGFDNIILRNWSYFELQKMIEYKAEREGITVRYVNPAYTSQKCSRCGEIDKENRQTQANFKCTKCGFELNADHNAAINIARSIEFV

SEQ ID NO: 352 - protein, 463 aa, Flavobacterium thermophilum
MTCTKTMRYQIVRPLDDDWEVFRYILNQISYETWNCLNRCAQYLWEADNFKKIYYSKFGIKFNVKDVEGVADDAYINRNLKKEFQKMNGDSVETITREVKVKMKKNKEDFMLGKASFLSFKKGHPILFRGSQVKINKSNDNNYIVTVRLLRKEYAEELYNGITVKTKNKKEEKVHKRNINDMNIRFYIKANDKYNKVILERVLNKEYKIGGSRIFMKGNKIFFDLVYSFEQKKDEKLDKNRIMGIDIGYNIPAAVAINDMPYKKWFIGDRKEIEDFRTKIEVRKKQLQKWSVWAGDGRVGHGIKTRIKPVLNIGEKINNFKNLKNHVWSREIINIALKNKCGTIQMEKLEGIIPEEYSFLKNWSFYDLQQKIEYKAREHGIDVVYIDPAYTSARCSKCGHIHKSYEKKDWRPEQGQFICQVCGYKENADINAARNIATPNIEKIIKEQLEKQEREQRNQKYIS

SEQ ID NO: 353 - protein, 464 aa, Phascolarctobacterium sp.
MSIKAIRLEILKPYNEPDTATPVTWNELGQVLRDVRYACSKTENYAITKCYLWEQFKIEYKNNNGIFPNAKDFKEMTDLYSQLTAMFPDVAAAIVNQADQVATRKWNNEKKDVLSLRRSLTSFKLDVPIPIHNKSYKLRKISEDNKIIYVINVNLLSKKSERQTTYSMVLKVKDNSSKTILDRLINKELSPKGIQIIGSNKNRQKWFCLIPYDFTEKDTELNPDRIMGIDLGIAKAVYYAFSDSYKRGYIEGGEIEHFRKSVRARRIAIQNQGKYCGDGRIGHGVKRRLQPVEALREKEKNFRNLTNHRYARRLVEVAVKNHCGVIQMEDLTSITKDNTFLKDWPYYDLQTKIAEKASEYGIVFKKINPYKTSQRCSRCGYIDSENRPEQSVFVCRECGYGNMYLCEDCNKEQNHAGKCDSCGGVTNLITVNADYNAAKNIATKDIEQIIKKTMGKDYNPPKKK

SEQ ID NO: 354 - protein, 471 aa, Bacillus pseudomycoides
MIIARKIKLIIIGEDRDTQYKFIREERYKQNKALNVAMNHLYFLHVAKEKIRLLDNKFLQDEKKLQEGIKKLYAEKKVIKDGKKRNELEKKIEKQTNELKKLRSKGNKEADKILQEAIKINLSSTTREVISKQFDLISDTKDRITQKVYQDFKSDLKNGLLSGERVLRTYKKNNPLLIRGRALNFYREGKDVMIKWFGGIIFKCMLGQHKNNAQELKATLNKVLEGSYKVCDSSISVGKELILNISLDIGEVNSNVSCKKGRVLGVDLGMKVPAYMSINDKPYIRKSLGSLDDFLRIRVQMQKRRRNLHKTLVSVKGGKGREKKLQALDRLKEKNFATTYNHFLSYNIVKFAKDNLAEQINMEFLALAGEDKNIILRNWSYYQLQQFVEDKAKREGIDVKYVDPYRTSQMCSKCRNYEPGQRESQEKFICKSCHLEINADYNASQNIAHSTKYITNKNQSEYFKKLQHTTE

SEQ ID NO: 355 - protein, 471 aa, Bacteroides plebeius
MPIITRKIELKIVKDGLTDEEYDQQWKYLYQINNTIYLAANRISTHCLFNDEYEMRLKLHMPRYKEIEKELKKLDSDKKTSDKEIRDRLLNERKELDEDVKNKKKDFLQCSKQNSTYQLVSKEFKQYIPSDILANLNQKIQENYNNNQKKIESGERALSTYKKGMEIPFSIRENKRLKLFIKEEGIYLKWFKEILFRLEFGKDASNNRCIVERLIESDRQQKNKGEDYVANNSSIKLVKYGKSTRIFLLLSIDIPAKKQVLDKDVVLGVDLGIKCPLYLAINKNDNFKMQIGDIEHFHNQRTMFQKRFKSLQKLMCTQGGHGRKKKLEPLEKLKEKERNWVHTQNHVYSREVIKQALKQNAGTIHMESLKDFGKGKDGYVKDEYKYLLRYWSYYELQSMIEYKAKLEGIEVKYIDPAYTSQTCSYCGERGERKKQEEFVCTNPQCKRRGEKINADFNAARNIAMSKKIVER

SEQ ID NO: 356 - protein, 477 aa, Clostridium botulinum
MPFILKQRGVRMITVRKLKIVCKDKEFYDFFKWEQREQNKALNIAIGLIHSSTVLRSIDSGAEAQLKKSIGKLTQNIEKLGKELEKEKITDKKKEQLLKAINTNKELIASKEKELKAGEEFRCGIDKKFNELYMNKTTLYHVLDSICDFKYKRTIELVRQKVKQDYSNSFTDIVTGKVSLQNYKSTFPLMIDGSCISILKEVDELDIVNGYKIKIMLGYELDIILGKRENENSLELQKTLEKCITGDYKICASSIQRDKNNNVIFNLTLDIPIEKDYKPVKGRVCGVDLGIKYPAYMCLNEDTYKKEAVGSINNFLRIRKQMQERRKKLQKELLLTNGGKGRTKKTQALEKLRENEKNFAKTYNHAISKRIVGFARKNKCEYINLEKLTKDGFGDSILRNWSYFELQKMIEYKAKSKGIEVRYIDPCFTSQKCSKCGYIDKENRETQEDFICKKCGFKLNADHNASINIARSKEFIK

SEQ ID NO: 357 - protein, 478 aa, Bacillus pseudomycoides
MIIARKIKLIIIGENRDAQYKFIREERYKQNKALNVAMNHLYFLHVAKEKIRLLDNKFLQDEKKLQESINKLYAEKKVIKDEKKRNELEKKIEKQTNELKKLRSKSNKEADKVLQEAIKINLSSTTREVISKQFELISDTKDRITQKVSQDFKSDLKHGLLSGERVLRTYKKNNPLLIRGRALNFYREGKDVMIKWYGGIIFKCMLGQHKNNAPELKATLSKVLEGSYKVCDSSISVGKELILNLSLDIGEVDTNVSCKKGRVLGVDLGMKVPAYMSINDKPYIRKALGSLDDFLKIRVQMQKRRRNLHKTLVNVKGGKGREKKLQALDRLKDKEKNFATTYNHFLSYNIVKFAKDNLAEQINMEFLALAGEDKNIILRNWSYYQLQQFVEYKAKREGIDVKYVDPYRTSQMCSKCGNYEPGQRESQEKFICKSCHLEINADYNASQNIAHSTKYITNKNQSEYLKKLQQTTKLEKYS

SEQ ID NO: 358 - protein, 478 aa, Bacillus pseudomycoides
MIIARKIKLIIIGENRDTQYKFIREERYKQNKALNVAMNHLYFLHVAKEKIRLLDNKFLQDEKKLQESINKLYAEKKVIKDEKKRNELEKKIEKQTNELKKLRSKGNKEADKVLQEAIKINLSSTTREVISKQFELISDTKDRITQKVSQDFKSDLKHGLLSGERVLRTYKKNNPLLIRGRALNFYREGKDVMIKWYGGIIFKCMLGQHKNNAPELKATLSKVLEGSYKVCDSSISVGKELILNLSLDIGEVDTNVSCKKGRVLGVDLGMKVPAYMSINDKPYIRKALGSLDDFLKIRVQMQKRRRNLHKTLVNVKGGKGREKKLQALDRLKDKEKNFATTYNHFLSYNIVKFAKDNLAEQINMEFLALAGEDKNIILRNWSYYQLQQFVEYKAKREGIDVKYVDPYRTSQMCSKCGNYEPGQRESQEKFICKSCHLEINADYNASQNIAHSTKYITNKNQSEYLKKLQQTTKLEKYS

SEQ ID NO: 359 - protein, 482 aa, Clostridium botulinum
MNTVRKIKLTILGDTETRNKQYKWIRDEQYNQYRALNLSMTYMVTNLMLKNNESGLENRKEKDVLKIENKIKKDEENLKKELAKKKINEEKIENINSNIEELKSEKEKLENELKNIKEYRSNIDEEFKKMYVDDLYNVLSKISFQHEDMKSLVTQRVKKDFNNDVKEIMRGDRSVRNYKRNFPILTRGRDLKFQYFEKSEDIEIKWIEGIKFKCILGKPSKSLELKHTLHKVINEEYKICDSSLQFDKNNNLILNLTLDIPENNKYEKIENRIVGVDLGLKIPAYVALNDTIYIRKSIGSINDFLKVRTQIQSRARKLQKSLQVVRGGKGRNKKMKALERFREKERNFARNYNHFLSYNIVKFALDNKAEQINLELLEMKKTQNKSILRNWSYYQLQSFIEYKAERVGIKVKYIDPYHTSQTCSECGNYEEGQRVEQDTFVCKRCGHKINADYNAARNIAMSDKYISKKEESEYYKNNKNMV

SEQ ID NO: 360 - protein, 482 aa, Clostridium botulinum
MNTVRKIKLTILGDTETRNKQYKWIKDEQYNQYRALNLSMTYMVTNLMLKNNESGLENRKEKDILKIENKIKKDEGSLKKELAKKKINEEKIENIKSNIEELKSEKEKLENELKNIKEYRSNIDEEFKKMYVDDLYNVLNKISFQHEDMKSLVTQRVKKDFNNDVKEIMRGDRSVRNYKRNFPILTRGRDLKFQYIEKSEDIEIKWIEGIKFKCILGKPSKSLELKHALHKVINKEYKVCDSSLQFDKNNNLILNLTLDIPQDNKYEKITNRVVGVDLGLKIPAYVALNDTKYIRKAIGSIDDFLKVRTQMQSRVRKLQKSLQVVRGGKGRNKKMKALERFREKERNFARNYNHFLSYNIVKFALDNKAEQINLELLEMKKTQNKSILRNWSYYQLQNFIEYKAERVGIKVKYIDPYHTSQTCSECGNYEEGQRVEQDTFVCKRCWHKMNADYNAARNIAMSYNYISKKEESEYYKNNKNMV

SEQ ID NO: 361 - protein, 482 aa, Clostridium botulinum
MNTVRKIKLTILGDTETRNKQYKWIRDEQYNQYRALNLSMTYMVTNLMLKNNESGLENRKEKDILKIENKIKKDEENLKKELAKKKINEEKIENIKSNIEELKSEKEKLENELKNIKEYRSNIDEEFKKMYVDDLYNVLNKISFQHEDMKSLVTQRVKKDFNNDIKEIMRGDRSVRNYKRNFPVLTRGRDLKFKYFEKSEDIEIKWIEGIKFKCILGRPSKSLELKHTLHKVINEEYKICDSSLQFDKNNNLILNLTLDIPENNKYEKIENRIVGVDLGLKIPAYVALNDTRYIRKSIGSINDFLKVRTQIQSRARKLQKSLQVVRGGKGRNKKMKALERFREKERNFARNYNHFLSYNIVKFALDNKAEQINLELLEMKKTQNKSILRNWSYYQLQTFIEYKAERVGIKVKYIDPYHTSQTCSECGNYEEGQRVEQDTFVCKRCGHKINADYNAARNIAMSDNYISKKEESEYYKNNKNMV

SEQ ID NO: 362 - protein, 486 aa, Hydrogenivirga sp.
MNKVLKLTAKREKVKFKLLLLETGREEEVKFYELREALERFVRGVRVAYLKTLPDSLEGLEEKGRPNTRAVNSNELSKRFPPECAKVKLGSLELELGKDNIASSIRYTIEKDIRENLKREFKTIAIKSVPIIARVHTTKSHPYEKAFGEVFRIFEISEPDEKNRVSVRVGVKFFKQVEVEGKKATPVLVVEAVMRLKGRDYATANSYYNILKRIKEGEYKVAYAGLSYREGSGISLLLSYNLPDISEDDKRENILGIDLGQACPVYWSLITPELEKKKLTNGRHPRGQIEYPVNLEGAIRKLWRAKRNLLSSLRRIEEQTSLLSEGNRDLKGRLLRRKREVERSLKGMRRKEKNLMKKMDEFLANEVIRVALRERCRKIRMERLDGVDKTELYFPKWNYGQLQNLIEQRASLYGIEVERVNPRKTSQRCPSCGYVGQRREEVRPTRDLFRCPECGEESFADFVGAFNVGIGGWEAFKPKEALSSSS

SEQ ID NO: 363 - protein, 489 aa, Bacillus megaterium
MITTRKFKLAIVSDNRNEAYSFIRNEIRNQNKALNAAYNHLYFEHIATEKLKHSDAEYQKHLTKYREVATNKYQDYLKAKEKVNASKDDEKLQKRVDKAREAYNKAQEKVYKIEKEFNKKSMETYQKVVGLSKQTRIGKLLKSQFTLHYDTEDRITSTVLSHFNNDMKTGVLRGDRSLRTYKNSHPLLVRARSMKVYEENGDYFIKWVKGIVFKIVISAGSKQKANIGELKSVLINILNGHYKVCDSSISLNKDLILNLSLNIPVSKENVFVPGRVVGVDLGLKIPAYVSLNDTPYIKKGIGNIDDFLRVRTQLQSQRKRLQKTLECTSGGKGRSKKLKGLDRLKAKEKNFVNTYNHFLSKKIIQFAVKNNAGVIHLEELQFDKLKHKSLLRNWSYYQLQTMIEYKAEREGIEVKYVDASYTSQTCSKCGHYEEGQRVLQDTFTCKNKECKGYVHKVNADFNASQNIAKSTDIIRCTEMAKNNDIEKNA

SEQ ID NO: 364 - protein, 491 aa, Clostridium fallax
MITVRKLKLSIMADEELRIQQLKWIKDEQYNQYRALNNGMAFLIADHMLNTAESTKIIYKNNEINKKKKKIYYMEDKIKKENNKLEEEKILKFESDINKLKHEIKILENEKVELELETKNLSEQFKNHYVEDMYTRLDEIPFQYKDNKSLVQNRLKKDFDFYLNNGGKRGERKPTAYKRDYPLLIRGRLLNFYYNKDNVFIKWIAGITFKVELGNKIKNNIELRHTLHQCMNNEKYKVCDSSLQFDNKNNIILNLTIDIPINTSENNFIEGRVMGVDLGMKIPAYASFNDVEYCRAFGDIEDFLRVRTQLQSRMRKLQMALTLIKGGHGRGKKLQALNRLKDKEKDFVNTYNHMISKRIIEYSIKNCCGVINLEYLSLAAREKDLFLTLQPQKSNRIKRNWSYYDLQTKIENKAKKYGIIVKKIDPYLTSQTCHICGNYDEGQRISQEQFECKACNRKFNADYNASKNIALSTKYINNINESEFFKRYKNN

SEQ ID NO: 365 - protein, 492 aa, Bacteroides plebeius
MPTITRKIELKIVKDRLTDEKERLTDEKYDQQWKYLYQINNTIYQAANRISTHCLFNDEYEMRLKLHMPRYKDIEKKLEEIEKKQKGLNTKKKASDKEERDRLLNEKQQLVNERKEIDEDVKNKKKDFLQCSKQNSTYQLVSKEFKQYIPSDILANLNQKIQENYNNNQKKIESGERALSTYKKGMEIPFSIRENKRLKLFIKEEGIYLKWFKEILFRLEFGKDASNNRCIVERLIESDKQQKGKGEDYVANNSSIKLVKNGKNTRIFLLLSIDIPAKKQVLDKEVVLGVDLGIKCPLYLAINKNDNFKMQIGDIEHFHNQRTMFQKRFKSLQKLICTQGAHGRKKKLEPLEKLKEKERNWVHTQNHVYSREVIKQALKQNAGTIHMESLKDFGKGKDGYVKDEYKYLLRYWSYYELQSMIEYKAKLEGIEVKYIDPAYTSQTCSYCGERGERKKQEEFICTNPQCKRRGEKINADFNAARNIAMSKKIVER

SEQ ID NO: 366 - protein, 496 aa, Bacillus thuringiensis
MILTRKVKLVIVSDNRDEGYKLIRNEIREQHKALNLAYNHLYFEHNAIQILKQNDEDYKQKRNKLQELINKKYEEHQKAKNLERKEALREAYNNKKQELYKFERECNEEARKAYQQVVGFTQQTRVRNLINREYNLMSDTKDGITSKVTQDYKNDCKAGLLIGKRSLRNYKKDNPLLVRGRSLKFYKEDGDYFIKWNKGTVFKCILHIRKKNVAELQSVLENVLLGAYKICDSSIGFNNKDMILNLSLNIPDKETYDYIPGRVVGVDLGLKIPAYVSLSDKVYVRKGIGGIDDFLRVRTQMQKRRRQLQESLAAVKGGKGREKKLKALDHLKGKEANFAKTYNHFLSTQIVTFAVKNQAGQINMEFLEFDKMKNKSLLRNWSYYQLQMMVEYKAKREGIIIKYVDAYLTSQTCSKCDYYEEGQREKQEKFICKSCAFEVNADYNASQNIAKSARYISDSTEREYHKKKQEDLKEILGENDIINEQLSLFDNHDDIA

SEQ ID NO: 367 - protein, 496 aa, Bacillus cereus
MILTRKVKLVIVSDNRDEGYKLIRNEIREQHKALNLAYNHLYFEHNAIQILKQNDEDYKQKRNKLQELINKKYEEHQKAKNLERKEALREAYNNKKQELYKFERECNEEARKAYQQVVGFTQQTRVRNLINRECNLMSDTKDGITSKVTQDYKNDCKAGLLIGKRSLRNYKKDNPLLVRGRSLKFYKEDGDYFIKWNKGTVFKCILHIRKKNVAELQSVLENVLLGAYKICDSSIGFNNKDMILNLSLNIPDKETYDYIPGRVVGVDLGLKIPAYVSLSDKVYVRKGIGGIDDFLRVRTQMQKRRRQLQESLAAVKGGKGREKKLKALDHLKGKEANFAKTYNHFLSTQIVTFAVKNQAGQINMEFLEFDKMKNKSLLRNWSYYQLQMMVEYKAKREGIIIKYVDAYLTSQTCSKCDYYEEGQREKQEKFICKSCAFEVNADYNASQNIAKSARYISDSTEREYHKKKQEDLKEILGENDIINEQLSLFDNHDDIA

SEQ ID NO: 368 - protein, 497 aa, Clostridium sp.
MITVRKIKLTIMGDKDTRNSQYKWIRDEQYNQYRALNMGMTYLAVNDILYMNESGLEIRTIKDLKDCEKDIDKNKKEIEKLTARLEKEQNKKNSSSEKLDEIKYKISLVENKIEDYKLKIVELNKIIEETQKERMDIQKEFKEKYVDDLYQVLDKIPFKHLDNKSLVTQRIKADIKSDKSNGLLKGERSIRNYKRNFPLMTRGRDLKFKYDDNDDIEIKWMEGIKFKVILGNRIKNSLELRHTLHKVIEGKYKICDSSLQFDKNNNLILNLTLDIPIDIVNKKVSGRVVGVDLGLKIPAYCALNDVEYIKKSIGRIDDFLKVRTQMQSRRRRLQIAIQSAKGGKGRVNKLQALERFAEKEKNFAKTYNHFLSSNIVKFAVSNQAEQINMELLSLKETQNKSILRNWSYYQLQTMIEYKAQREGIKVKYIDPYHTSQTCSKCGNYEEGQRESQADFICKKCGYKVNADYNAARNIAMSNKYITKKEESKYYKIKESMV

SEQ ID NO: 369 - protein, 497 aa, Bacteroides plebeius
MPTITRKIELKIVKDRLTDEKERLTDEEYDQQWKYLYQINNTIYQAANRISTHCLFNDEYEMRLRLSYKSRYDKINKGLENIKTELEKLNTKKKTSDKEKRDRLINEQRQLVDERNELDEDVKNKKKDFFQCSKQNSTYQLASKEFLKYIPAEILTDLNRYVQNNHNNNKKKVKSGERALSTYKKGMGIPFSIKPQSGLRLFVKEEGIYLKWFKGILFRLEFGKDTSNNRCIVERLIESDKQQKKNKGEDYVANNSSIKLIKKGNDKSTRIFLLLSIDIPAKKQVLDKEVVLGVDLGIKCPLYLAINKNDNFKMQIGDIEHFHNQRTMFQKRFKSLQKLMCTQGGHGRKKKLEPLEKLKEKERNWVHTQNHVYSREVIKQALKHNAGTIHMESLKDFGKGKEGYVKDEYKYLLRYWSYYELQSMIEYKAKLEGIEVKYIDPAYTSQTCSYCGERGERKKQEEFVCTNPQCKRRGEKINADFNAARNIAMSKKIVKDN

SEQ ID NO: 370 - protein, 536 aa, Dorea longicatena
MSDEITITRKYVIYPIASDMKEWERKVIKYVSENYEKRIQLLEQKIKHSKIPKEEKENLRKELDNLKIKYDAFQADPAITQSEINTYTYGTVRTAMEEEARKKNYILSWIYSEMIGAGVQHMETLKEKYQFISNRMNYAYRLPGNKNGSLFDEAEIHNILKGYGFAFSQMLTSKIKDCVKKGLLEGKVSLPNYKIDSPFTVAKACMGFSHDYDNFEELCEHIHDSDLKLYFDYGGNKRPSIAKFKIDLGKGKNREELAATLLKVYSGEYEYCGSSIQISKKKIILNLSMKIPKIPTELDENTVVGVNLGVAIPATCALNNDLHKKLYIGTYEEFAHQKVKLQEQRKRLQISLRNTSGGHGRKKKLQALERLKAREKQYTETVCHKISKRIVDFALKNHAKYINLENLQGYDTNEFILRNWCYYRLQQYTEYKAARYGIIVRKVNPCYNAQICSICGGWDKDQRLSRADFICKDPNCISHKKYKHPQCAEFNNARNVAMSELFMESGKVTGKDFERARAYYSKKNPGIIWEFVESKE

SEQ ID NO: 371 - protein, 543 aa, Sulfurihydrogenibium azorense
MVNKNLKITSGRDNVEFYLIVDGEEIPLKKQDIRNLITEFLKDVRLAYIKFLPNIELIQTGKYFTVNINSKRLTNENLSNSLTKLIPKNYIELEINGSKVKLDYKKDYVATSILYSVAKDITGNLKEGKTVVIKNLQYLARIKPDKNTPYDKAFSQVIKEFEIVENGKTVECVITFSAFKNASIKVKFKMNLRKKNFAVNNSYYQILNRIKNQEYKVAYIGIGYREKKGAFLLISYKFEKQPETSQEQEKVMGVDLGQVYLIYYSITNSHSRGDISLSYSWKDKIIGIWNRKKHLQKSLMEIRNLKKQGINDESIEKRYEKIVKELNSVREYEKNFMETLNKQIATKLIDIAVKEKVKTIVLEDLSLSNEEKNSLAFPKWNYYQLQSFIENKAQENGIQVKKINPAYTSQRCPSCGFIAFYKEMVRPKREKFTCPVCGFSSNADYVASLNIAEENIEEKIKARLISDIEKIEKVDKNNKVFTLFAIRNRIVKDLLKEFFNTNNGSSKKLLKRLEISNKEAYNTLIRDLKQFKVEYLDKRISNV

We claim:

1. A synthetic composition comprising:
   (a) a Cas endonuclease or a functional fragment thereof, comprising an amino acid sequence that is at least 90% identical to SEQ ID NO: 37 wherein the Cas endonuclease or the functional fragment comprises a tri-split RuvC domain, at least three zinc finger motifs, and the following amino acid motifs: GxxxG, ExL, $Cx_nC$, and $Cx_n(C$ or H); wherein G=Glycine, E=Glutamate, C=Cysteine, H=Histidine, x=any amino acid and wherein n=an integer between 0 and 11;
   (b) a target double-stranded DNA polynucleotide, wherein the target double-stranded DNA polynucleotide is heterologous to the source of the Cas endonuclease, and
   (c) a guide polynucleotide comprising a variable targeting domain that comprises a region of complementarity to the target double-stranded DNA polynucleotide;
   wherein the Cas endonuclease or the functional fragment thereof recognizes a PAM sequence on the target double-stranded DNA polynucleotide, wherein the guide polynucleotide and the Cas endonuclease or the functional fragment thereof, form a complex that binds to the target double-stranded DNA polynucleotide, wherein the Cas endonuclease or the functional fragment thereof comprises DNA binding activity.

2. The synthetic composition of claim 1, wherein the Cas endonuclease is provided as a polynucleotide encoding the Cas endonuclease.

3. The synthetic composition of claim 1, wherein the Cas endonuclease cleaves the double-stranded DNA polynucleotide.

4. The synthetic composition of claim 1, further comprising a heterologous polynucleotide.

5. The synthetic composition of claim 4, wherein the heterologous polynucleotide is an expression element.

6. The synthetic composition of claim 4, wherein the heterologous polynucleotide is a transgene.

7. The synthetic composition of claim 4, wherein the heterologous polynucleotide is a donor DNA molecule.

8. The synthetic composition of claim 4, wherein the heterologous polynucleotide is a polynucleotide modification template.

9. The synthetic composition of claim 1, further comprising a deaminase.

10. The synthetic composition of claim 1, wherein the Cas endonuclease is part of a fusion protein.

11. The synthetic composition of claim 10, wherein the fusion protein further comprises a heterologous nuclease domain.

12. The synthetic composition of claim 1, further comprising a eukaryotic cell.

13. The synthetic composition of claim 12, wherein the eukaryotic cell is a plant cell, an animal cell, or a fungal cell.

14. The synthetic composition of claim 13, wherein the plant cell is a monocot cell or a dicot cell.

15. The synthetic composition of claim 13, wherein the plant cell is from an organism selected from the group consisting of: maize, soybean, cotton, wheat, canola, oilseed rape, sorghum, rice, rye, barley, millet, oats, sugarcane, turfgrass, switchgrass, alfalfa, sunflower, tobacco, peanut, potato, *Arabidopsis*, safflower, and tomato.

16. The synthetic composition of claim 1, wherein at least one component is attached to a solid matrix.

17. A synthetic composition comprising:
(a) a Cas protein or functional fragment thereof, comprising an amino acid sequence at least 90% identical to SEQID NO: 37, wherein the Cas protein or the functional fragment thereof comprises a tri-split RuvC domain and at least three zinc finger motifs;
(b) a target double-stranded DNA polynucleotide, wherein the target double-stranded DNA polynucleotide is heterologous to the source of the Cas protein; and
(c) a guide polynucleotide comprising a variable targeting domain that comprises a region of complementarity to the target double-stranded DNA polynucleotide;
wherein the Cas protein recognizes a PAM sequence on the target double-stranded DNA polynucleotide, wherein the guide polynucleotide and the Cas protein form a complex that binds to the target double-stranded DNA polynucleotide; wherein the Cas protein comprises DNA binding activity and lacks double-strand DNA cleavage activity.

18. A construct comprising a polynucleotide encoding a Cas protein operably linked to a heterologous expression element, wherein the Cas protein shares at least 90% sequence identity with SEQID NO:37 and comprises at least three zinc finger motifs, and a tri-split RuvC domain, and wherein the Cas protein comprises DNA binding activity.

19. A method of introducing a targeted edit in a target polynucleotide, comprising providing a heterologous composition comprising:
(a) a Cas endonuclease or a functional fragment thereof, comprising a polypeptide at least 90% identical to SEQID NO:37, wherein the Cas endonuclease or functional fragment comprises at least three zinc finger domains, a tri-split RuvC domain, and the following amino acid motifs: GxxxG, ExL, $Cx_nC$, and $Cx_n(C$ or $H)$; wherein G=Glycine, E=Glutamate, C=Cysteine, H=Histidine, x=any amino acid and wherein n=an integer between 0 and 11,
wherein the Cas endonuclease recognizes a PAM sequence on the target polynucleotide, and wherein the Cas endonuclease comprises DNA binding activity; and
(b) a guide polynucleotide comprising a variable targeting domain that is substantially complementary to a portion of the target polynucleotide, wherein the guide polynucleotide and Cas endonuclease form a complex that can recognize and bind to the target polynucleotide.

20. The method of claim 19, further comprising a cell, the method further comprising introducing at least one nucleotide modification in the genome of at least one cell of the organism as compared to the target sequence of the genome of the cell prior to the introduction of the heterologous composition, further comprising incubating the cell and generating a whole organism from the cell, and ascertaining the presence of the at least one nucleotide modification in the genome of at least one cell of the organism as compared to the target sequence of the genome of the cell prior to the introduction of the heterologous composition.

21. The method of claim 19, wherein the cell is a eukaryotic cell.

22. The method of claim 21, wherein the eukaryotic cell is derived or obtained from an animal, a fungus, or a plant.

23. The method of claim 22, wherein the plant is a monocot or a dicot.

24. The method of claim 22, wherein the plant is selected from the group consisting of: maize, soybean, cotton, wheat, canola, oilseed rape, sorghum, rice, rye, barley, millet, oats, sugarcane, turfgrass, switchgrass, alfalfa, sunflower, tobacco, peanut, potato, *Arabidopsis*, safflower, and tomato.

25. The method of claim 19, further comprising introducing a heterologous polynucleotide.

26. The method of claim 25, wherein the heterologous polynucleotide is either a donor DNA molecule, or a polynucleotide modification template that comprises a sequence at least 50% identical to a sequence in the cell.

27. A progeny of the organism obtained by the method of claim 20, wherein the progeny comprises the Cas endonuclease or functional fragment thereof.

* * * * *